(12) United States Patent
Shalitin et al.

(10) Patent No.: US 11,319,553 B2
(45) Date of Patent: May 3, 2022

(54) COMPOSITIONS AND METHODS CONFERRING RESISTANCE TO FUNGAL DISEASES

(71) Applicants: EVOGENE LTD., Ness-Ziona (IL); RAHAN MERISTEM (1998) LTD., Western Galilee (IL)

(72) Inventors: Dror Shalitin, Raanana (IL); Sharon Ayal, Bet Nir (IL); Ada Viterbo Fainzilber, Rehovot (IL); Hagai Karchi, Sitriya (IL); Eli Khayat, Nahariya (IL); Tanya Gontmakher, Nahariya (IL)

(73) Assignees: RAHAN MERISTEM (1998) LTD., Western Galilee (IL); EVOGENE LTD., Ness Ziona (IL)

( * ) Notice: Subject to any disclaimer, the term of this patent is extended or adjusted under 35 U.S.C. 154(b) by 0 days.

(21) Appl. No.: 16/767,827

(22) PCT Filed: Nov. 27, 2018

(86) PCT No.: PCT/IL2018/051290
§ 371 (c)(1),
(2) Date: May 28, 2020

(87) PCT Pub. No.: WO2019/106662
PCT Pub. Date: Jun. 6, 2019

(65) Prior Publication Data
US 2021/0002664 A1  Jan. 7, 2021

Related U.S. Application Data

(60) Provisional application No. 62/591,772, filed on Nov. 29, 2017.

(51) Int. Cl.
*C12N 15/82* (2006.01)
*C07K 14/415* (2006.01)

(52) U.S. Cl.
CPC ........ *C12N 15/8282* (2013.01); *C07K 14/415* (2013.01)

(58) Field of Classification Search
CPC .................... C12N 15/8282; C07K 14/415
See application file for complete search history.

(56) References Cited

U.S. PATENT DOCUMENTS

| | | |
|---|---|---|
| PP8,983 P | 11/1994 | Rowe |
| PP9,791 P | 2/1997 | Rowe |
| PP15,863 P3 | 7/2005 | Rowe |
| 7,534,930 B2 | 5/2009 | Vishnevetsky |
| 9,408,395 B2 | 8/2016 | Castillo |
| PP27,419 P3 | 11/2016 | Aguilar Moran |
| PP28,246 P3 | 8/2017 | Aguilar Moran |
| 9,770,036 B2 | 9/2017 | Rodriguez Quintero |
| 2002/0124287 P1 | 9/2002 | Rowe |
| 2007/0044171 A1* | 2/2007 | Kovalic ............... C12N 15/902 800/278 |
| 2015/0223468 A1 | 8/2015 | Rodriguez Quintero |
| 2015/0223469 A1 | 8/2015 | Rodriguez Quintero |
| 2016/0272993 A1* | 9/2016 | Abad ................ C12N 15/8274 |

FOREIGN PATENT DOCUMENTS

| | | |
|---|---|---|
| CN | 101536689 B | 4/2013 |
| CN | 103081933 A | 5/2013 |
| CN | 104126595 B | 4/2016 |
| CN | 105494445 A | 4/2016 |
| IN | 9090DEN2014 A | 5/2015 |
| JP | 2013231003 A | 11/2013 |
| JP | 2015199754 A | 11/2015 |
| MX | 2010000823 A | 7/2010 |
| MX | 2016010348 A | 5/2017 |
| NZ | 625074 A | 11/2015 |
| NZ | 703856 A | 12/2015 |
| RU | 2536492 C2 | 12/2014 |
| WO | 2004036996 A1 | 5/2004 |
| WO | 2004039993 A1 | 5/2004 |
| WO | 2005019408 A2 | 3/2005 |
| WO | 2008122980 A2 | 10/2008 |
| WO | 2011099878 A2 | 8/2011 |
| WO | 2014153042 A1 | 9/2014 |
| WO | 2016184879 A1 | 11/2016 |

(Continued)

OTHER PUBLICATIONS

Preston et al (Functional evolution in the plant Squamosa-Promoter Binding Protein-Like (SPL) gene family. Front. Plant Sci., 05, 1-13, 2013) (Year: 2013).*
Grosse-Holz (Juggling jobs: roles and mechanisms of multifunctional protease inhibitors in plants. New Phytologist. 210: 794-807, 2016) (Year: 2016).*
Paiva et al (Protease inhibitors from plants: Biotechnological insights with emphasis on their effects on microbial pathogens. FORMATEX 2013, 641-649) (Year: 2013).*
Jamal et al (Serine protease inhibitors in plants: nature's arsenal crafted for insect predators. Phytochem Rev 12:1-34, 2013) (Year: 2013).*
Friedberg (Automated protein function prediction—the genomic challenge. Brief. Bioinformatics. 7:225-242, 2006) (Year: 2006).*
Mochida et al (CJ649506, published Feb. 22, 2012) (Year: 2012).*
Shan et al (M4VP35_WHEAT, published May 29, 2013). (Year: 2013).*

(Continued)

*Primary Examiner* — Bratislav Stankovic
*Assistant Examiner* — Wayne Zhong
(74) *Attorney, Agent, or Firm* — J.A. Lindeman & Co. PLLC

(57) ABSTRACT

The present invention relates to polynucleotides and polypeptides associated with increased resistance of plants towards pathogenic fungi of the genus *Mycosphaerella*, and fungi related thereto, particularly towards fungi inducing Sigatoka disease complex and fungi inducing other diseases in banana and additional *Musa* plant spices; to use thereof for controlling plant disease associated with the fungal pathogens; and to the production of genetically engineered plants having increased resistance to the pathogenic fungi.

6 Claims, 7 Drawing Sheets

Specification includes a Sequence Listing.

(56) References Cited

FOREIGN PATENT DOCUMENTS

| | | |
|---|---|---|
| WO | 2017103582 A1 | 6/2017 |
| WO | 2017157923 A1 | 9/2017 |

OTHER PUBLICATIONS

Oldach et al (Heterologous Expression of Genes Mediating Enhanced Fungal Resistance in Transgenic Wheat. Molecular Plant-Microbe Interactions. 14: 832-838, 2001) (Year: 2001).*

Altschul et al., (1990) Basic local alignment search tool. J Mol Biol 215(3): 403-410.

Arango Isaza et al., (2016) Combating a Global Threat to a Clonal Crop: Banana Black Sigatoka Pathogen *Pseudocercospora fijiensis* (Synonym *Mycosphaerella fijiensis*) Genomes Reveal Clues for Disease Control PLoS Genet 12(8): e1005876; 36 pages.

Arzanlou et al., (2007) Molecular diagnostics for the sigatoka disease complex of banana Phytopathology 97(9): 1112-1118.

Chang et al., (2016) Comparative Genomics of the Sigatoka Disease Complex on Banana Suggests a Link between Parallel Evolutionary Changes in Pseudocercospora fijiensis and Pseudocercospora eumusae and Increased Virulence on the Banana Host. PLoS Genet 12(8): e1005904; 35 pages.

Chen et al., (2010) SQUAMOSA promoter-binding protein-like transcription factors: star players for plant growth and development. J Integr Plant Biol 52(11): 946-951.

Churchill (2011) Mycosphaerella fijiensis, the black leaf streak pathogen of banana: progress towards understanding pathogen biology and detection, disease development, and the challenges of control. Mol Plant Pathol 12(4): 307-328.

Cui et al., (2014) The miR156-SPL9-DFR pathway coordinates the relationship between development and abiotic stress tolerance in plants Plant J 80(6): 1108-1117.

Edgar (2004) MUSCLE: multiple sequence alignment with high accuracy and high throughput. Nucleic Acids Res 32 (5): 1792-1797.

Escalant et al., (1994) Amplified somatic embryogenesis from male flowers of triploid banana and plantain cultivars (*Musa* spp.). In Vitro Cell Dev Biol—Plant 30: 181-186.

Etebu and Young-Harry (2011) Control of black Sigatoka disease: Challenges and prospects. African Journal of Agricultural Research 6(3): 508-514.

Gupta et al., (2014) Current status on role of miRNAs during plant-fungus interaction. Physiological and Molecular Plant Pathology 85: 1-7.

Lev-Maor et al., (2003) The birth of an alternatively spliced exon: 3' splice-site selection in Alu exons. Science 300 (5623): 1288-1291.

Metzker (2010) Sequencing technologies—the next generation. Nat Rev Genet 11(1): 31-46. https://doi.org/10.1038/nrg2626.

Mitchell et al., (2015) The InterPro protein families database: the classification resource after 15 years. Nucleic Acids Res 43(Database issue): D213-D221.

Needleman and Wunsch (1970) A general method applicable to the search for similarities in the amino acid sequence of two proteins. J Mol Biol 48(3): 443-453.

Ortiz (1997) Secondary polyploids, heterosis, and evolutionary crop breeding for further improvement of the plantain and banana (*Musa* spp. L) genome. Theor Appl Genet 94: 1113-1120.

Portnoy et al., (2009) Analysis of the Melon Fruit Transcriptome Based on 454 Pyrosequencing. Plant & Animal Genomes XVII Conference, Jan. 10-14, 2009, San Diego, CA, USA. 1 page.

Portnoy et al., (2011) Use of Non-Normalized, Non-Amplified cDNA for 454-Based RNA Sequencing of Fleshy Melon Fruit. The Plant Genome 4(1): 36-46.

Xie et al., (2002) Computational analysis of alternative splicing using EST tissue information. Genomics 80(3): 326-330.

Yelin et al., (2003) Widespread occurrence of antisense transcription in the human genome. Nat Biotechnol 21(4): 379-386.

Database NCBI [Online], Oct. 25, 2016 (Oct. 25, 2016). Predicted: squamosa promoter-binding-like protein 9 isoform X1 [*Musa acuminata* subsp. *malaccensis*]. https://www.ncbi.nlm.nih.gov/protein/XP_009417907.1?report=genbank&log$=protalign&blast_rank=1&RID=7R94A6BY01N.

* cited by examiner

FIGURE 2A

TATCTGTGTTGAATGAAGAGAGATTGAATCCGAGAATAATCTCACATTACTAAACATTGAAAATCTGGTTAAAATTTGGATTGAT
TTGATGTTTAATCTAATATATGTAATTTGAATCAATTTTTGTTGTTGTGTATGCTGAATCTAACAATCTTATGATTCAAAATA
TGCCTATAATTAATATGAAATTGATCAGGACATATAATCCTTATTCCTATAACTAGTCAATATATCAATCATTGATGCT
TGACTCAAACTTATTGATTACACATGCTGACTCTGACACACACACTTATGAGTCTACTCTTTACAATATATCTATAATT
AAGAGTCAACAAAACTATTCTAATTTTCGATCCAATTCATCATACTATTTCATTATTCCATTAAAAAAGT
TAAATTCATGATGATAAACCTAATGGTGTGGTACCATCACACTACTGATTGGAACTTCATTAAAATACCATTAAAATGCCTG
TATGAGCACAAAAGTCAGAGTGAATTGGAACTTTCATTAAAATACCATTAAATAGTTGAGAAGTTCTGTCACCAAACATGATCGATT
GTACTATAAAAAGCTAATAGATAAAAAAAACATGCATTAATTAATGCCCTGTAATCTGGTGAAGAAGAAACTTGTCTTCAA
CCTAGCAAAAGCAAACTACTCATCCATTGACGAAGAAGCCCTGTAATCTGCGTAATCTGGTGAAGAAGAAACTTGGAAGAGTCATGATGG
TAGAAACCACGAAGGCTGCTCTGCGTGCTCCGTCGAAGCTGCTCCGTGAGTGATATTGTTGTTACCGGAGACAGAGAGACAGGAAGCCATCCAAAGT
CCATGGCTTCGATGATATGGTTGAGAAGTTCATGGCTTATCTGGATCAATGGCGTGTGGATAACTCCTACT (SEQ ID 308)
TGAAGAGAAAGTCATGGCTTATCTGGATCAATGGCGTGTGGATAACTCCTACT (SEQ ID 308)

FIGURE 2B

ATGTAACGTGGATGCAATATATTCTCACACTCAATCAACTCATCTGAGCTTATCTTAGTTGAAGATTTGGATCATCATCTTCCTCG
ACTTTGTTAGGTCATTGACTTGTGGAATGAGCAAGTGTGGGATGATTGCTTACTAAGACTGAAGGATGTGATGATACTCGATTAA
CTTAATAGTTTGATTGGAGAATGGAGATAAGACACAGAGTGTGCTTCTAATTCGATTACATATTTAATCGAATCGACTCAAAT
CTATTAATATGGTTTGTTAACCTATTTAACATATATTAAAATCAGAATCTTGGTCAAATGTCAAT
GACATATGACTCATGTCGTAAAATTAACATTGAGCCCTATAAATTGAATCAAATTTCTCCTATAAATTTAAACACATTTAGATTGAATTGGA
CTTACTAAAGTTTGGATAAAAGCCCAAAATTAATCCTATAAATTTAATCACACATTTTATTGGTATAGTTATGTA
CGCATACTTATCTCTAATATCGAATTAGAATGAAAGAATAGACGGCAAGGTACAGATACCTATAAAAGAAATCCAATTTAATGCAGCCAATATGCCCAACCCAAAT
ACATGAACTCGTTTTAAACTCGAATCTCAATGATTAGAAGGAATAGACGGCAAGGTACAGATACCTATAAAAGAAATCCAATTTAATGCAGCCAATATGCCCAACCCAAAT
GCCACCTCAGGAGGAGCGTGAAATCTCCACTACATCCTATAAAGGGTACAGATACCTATAAAGAAATCCAATTTAATGCAGCCAATATGTCACAGATCTTGTCA
TCGTGTTTACCTCACTACATCCTCAATCTTGATTAGTTTCTTTTGAATAATAAAAAATATCTTTAC
AATATTTACTAAGATGCGGTAGTGATTATATAAAAATATTTATCGTTTGCTGATACAACACCATATTATCTCTTTTCAAGGA
ATTTGAGCCCGCGATTCAAAATATTCAAAATATTAATCTTCGTAGACATCAATCAATCTACTATAA (SEQ ID 309)

FIGURE 2C

TGTGGATAACTCCTACTTGG (SEQ ID 306)

FIGURE 2D

TGTGGATAACTCCTACT (SEQ ID 310)

FIGURE 2E

TTGCATCCACGTTACATTCT (SEQ ID 307)

FIGURE 2F

ATGTAACGTGGATGCAA (SEQ ID 311)

FIGURE 2G

ATGAGTTCGCTGCGAGCTTCCTCCTCCAAACTTGTGTGGTGGCCGCTTTGGTCGTGTCACTCATGGCCTTGTGTGAGGCGCAGC
TCACGCCTAACTACGGCAAGACCTGCCCACAGGTGCTGCTGCCAACCGTCAAGAAAGCCACCGGTACGGCGATCGCTCGAGAGCA
TCGCCATGGCCGCGTCCCTCCGCTCCTCCGACTCGCTTTGTTCAGGTTGTGACGCGTCCATCTTGCTGAACGATGCG
GCGGGCATCGTGAGCGAGAAGCACGTCAAAACTTCAGATCGCAGGAGGATACGAAGTGATCGACGGCATAAAGTCGGCCG
TGGGGAAGGTGTGTCCGGGCGTCGTGTTGCTGATATCCTTGCACGAGTCGTTGCACGGCAAAGATCTGGCAGAGCAAAACCTGCCAATAGCCTTCGAC
TTCATGGAAGGTGAAGCTCGGAAGAGACTCCACCTCCGTGTTCCGGGGAGGATACAACGAGACGAACATCGACCGGATGCGGCAGCCG
GACCTCGACACGGCTCACCTCCGCCACCTTCGCCAACGGTGACACAGAGACCTCAGCCTGCAAGGACTCAGCGTCGTCCTCTCAGGATCGCACCATCG
GGCTGGCTCAGTGCGCCACTGCGCCAGCAGAAGGGCCTTCTGCCGCAACGGTGACACAGAGACCTGGTCACCCCGGGTCTACCGACGCCACGTGGTGGCGT
GTGCCCTCCGACGCCGGAAAGAACCTGCTGGGAAAGGCGGCTTTCTTGCCGACTTCGCGGCTGCCAGCTGCCATGTGAAGATGGGGCGACATCAGCGCCCCCCCTCACTGGCTCCGC
ACAGCAAGGACCAGGCGGCTTTCTTGCCGACTTCGCGGCTGCCAGCTGCCATGTGAAGATGGGGCGACATCAGCGCCCCCCCTCACTGGCTCCGC
CGGGGAGGTCAGGAGAAGGTCTGCAGCGTGGTGAACTAA (SEQ ID 313)

FIGURE 2H

TATCTGTGTTGAATGAAGAGAGATTGAATCCGAGAATAATCTCCACATTACTAAACATTGAAAATCTGGTTAAAATTTGG
ATTGATTTGATGTTTAATCTAATATATGTAATTGAATCAATTTTTGGTTGTGTATGCTGAATCTAATCAACAATCTTA
TGATTCAAAATATGCCTATAATTAATGAAATTGATCAGGACATAAATGCTAAATGATATATAATCCTTATTCCTATAAC
TAGTCAATCATTGATGCTCAAACTTATTGACTCAACATGCTGACTCTGACACACACACTTATGAGTCTACCTACT
CTTTACAATAATAATATATCTATAATTAAGAGTCAACAAAACTATTCTAATTAATATTTCGATCCAATTCATACTATTTCA
TCTTCATCATTTATTCCATTAAAAAAAGGTTAAATTCATGATGATAAACCTAAATGATTGGTGTGGTACCATCACACTAC
TGATGTGTCTTTTCCAACAGACAAAAGTAGGCCTGTATGAGCACAAAAGTCAGAGTGAATTGAACTTTCATTAAAATA
CCATAATAGTTGAGAAGTTCTTGTCACCAAACATGATCGATTGTACTATAAAAAGCTAATAGATAAAAAAACATGC
ATTAATTAATGCTTGTTTTTACATGCTCCAATGACATCTTTGTCTTCAACTAGCAAAAGCTACTCATCCATTGACG
AAGAAGCCCTGTGCTAATCTTGGTGAAGAAGAAACTTGGAAGAGTCATGATGGTAGAAACCACGAAGGCTGCTTCTGCG
TGCTGTGTGAGTGATGATATTGTGTTACCGGAACCCTATTGTCGGACGCAAATAGGGACCCATGGCTTCGATGATATGG
TTGAGAAGCTGCTCCGTCGCAGTCAATGGCG*TGTGGATAAACTCCCTACT*TGGCTTCCCTATAAGCAGATGGCGATGCCATGTTTT
ATGGCTTATCTGATCAATGGCG*TGTGGATAAACTCCCTACT*TGGCTTCCCTATAAGCAGATGGCGATGCCATGTTTT
GGTAGATACACTAAGACTGGAGGCGCAGCTCACGCGCCTAACTACGGCAAGACCTGCCCACAGTGCTGCCAACCGTCAAGAAAGCC
TGGCCTTTGTGTGAGGCGCAGCTCAGAGCGCGATCGCTCGGAGAGCATGCGGGATGCGGGGCATCGTGAACGATGCGGGGCATCGTGAAC
ACCGGTACGGCGATCGCCATCTGCTGAACGATGCGGGGCATCGTGAACGATGCGGGGCATCGTGAGCCATTTCCATTCCATGACTGCTTTGTTCAGG
TTGTGACGCGTCCATCTTGCTGAACGATGCGGGGCATCGTGAACGATGCGGGGCATCGTGAGCCGGGCATCGTGAACGTCAAAACTTCAGATCTGCGA
GAGGATACGAAGTGATCGACGGCATAAAGTCGGCCGTGTGTCGGGCGTCGTGTCTTGTCTGATATCCTT
GCCATCGTTGCACGAGACTCCTCCGTATACGTGGGTGGGCCTTCATGGACGACCTTGAAGGTGAAGCTCGACAGACTCCACCAC
CGCCAGCAAAGATCTGGCAGAGACAAATCTGCCAATAGCCTTCGACACACCTGGCTCAGTGCGCCACCTTCCGCGCGC
AAGGACTCAGCTCAAAGACGACGAACATGGTCGTCCTCTCAGGATCGCACCATGCGCCAGGATGCGCCGGCGTCAGTGCCCTCCGACCCGGCAACGG
AGGATATACAAGAGACGAACATGGTCGTCCTCTCAGGATCGCACCATGCGCCAGGATGCGCCGGCGTCAGTGCCCTCCGACCCGGCAACGGAACCTGCTGGAAAGA
TGACACAGACCTGGCCACTGACCTGTCACCCCGCTGTCACCCCCACGGGTCTACCCGACGCCACGGTGGCGTAACGCCACGGTGGCGTAACGGACCAG
AGGGCCTGCTGCACTGGACCAGCTCCTTCGCCGCTGCCCATGGCTCCGCCATGCTGTAACGGCCACTCGCTCCGCGGGAGT
GCGGCTTTCTTCGCCGACTTCGCCGTGGTGAACTAACGCGCTGTTATCCTCTCTCTCACTCGTGTGT
CAGGAAGGTCTGCAGCGTGGTGACGTCCAAATGCGTCAGATGCGTCCAAATGCGTCAGATGCGTCTTATACGTTGTCGGTGTTGATTGCCTCGC
TGTGTGTGTGTGTGTGTGTGTGTGTGTGTGTGTGCAATGCAATGTTTCTTCGCGAAGCCCATATGTTTCTATCAATAATGAAGTCCACGTT
GATCTAAAGAACACGTAATCTATGATTGTATTGATTAATTGATTAATTTATTTATTCAACACATAGTCAAATTGCT
CACACTTGCCCATATTTTATGTAGA*ATGTAACGTGGATGCAA*TATTTCTCACACTC

FIGURE 2H (CONT.)

GACTTGTTAGGTCATTGACTTGTGGAATGAGCAAGTGTGGGATGATTGCTTACTAAGACTGAAGGATGTGTGATGTACTCG
ATTAACTTAATAGTTGATTGAAGAATATGGAGAGATAAGAGACACAGAGTGTGCTTCTAATTCGATTACATATTTAATCGAATCG
ACTCAAAATCTATTAATATGGTTTGTTAACCTATTTATCATTTAAATAATTAACATATATTAAATAAATCAGAATCTTG
GTCAAATGTCAATGACATATGACTTCATGTCGTAAAATTATACATTAAATTGAATCAAATTGGGCCTATAAATTAGATTA
AGGGCAAGAATATTGGACTTACTAAAGTTTGGATAAAAGCCCAAAATTAATCCTATAAATTTCTCCTCTAACTTAAACACA
TTTATTGGTATAGTTATGTACGCATATCTAAATATCGAAAGATTATTATCTCTAAATTATAAAAAAATATTT
TTTATCGTTGAACAGTGGTTTTGCTACATGAACTCGTTTTAAACTCGATTAGAAGGAATAGATACTTGGAAAGAAATCCAAT
TAATGCAGCCAATATGCCCAACCCAAATGCCACCTCAGGAGGAGCGTGAATCTACATAGACGGCAAGGGTACAGATACTA
AAGGACAGGCCATGTTTCATGGAGATCTTGTCATCGTGTTTACCTCACTACATCTCAAATCCTTATAAAATGATTTGATTTGA
TTAGGTTTCTTTTGAATAATAAAATATCTCTTTTCAAGGAATTTGAGCCCGCGATTCAAAATATTTAATCTTCGTAGACAT
ATCGTTTGCGTCGATACAACACCATTATCTCTTTTTCAAGGAATTTGAGCCCGCGATTCAAAATATTTAATCTTCGTAGACAT
CAATCTACTATAA (SEQ ID 312)

FIGURE 3A

TGGTGCATACTGGACTTGCA    (SEQ: 314)

FIGURE 3B

TGGTGCATACTGGACTT    (SEQ: 315)

FIGURE 3C

```
ATGGCTAGACTTGGAGGTGAGGCAACGTTGACATCCCGCCTACTCTTCTTCTTGCTATCGACGGCGG
TGATGGGTGGCAGCGCGACGGTGGAGACAAGGAGAAGTGTGCTGGGAATGCCTCGGCAGAACTCCTCC
CATGGGGTGGAACAGCTGGAACCATTTCCACTGCAACATCAACGAGCGGCTCATCAGAGAGACTGCTGAT
GCATTGGTGCATACTGGACTTGCAGGGCTGGTTATCGCTACGTTAACATAGATGATTGCTGGGAGAAG
CCAATAGAGACTACCAGGGAAATTTAGTTGCTAAGCTGAAGCAACATTTCCTTCCGCATAAAGTCTCTTGC
AGATTACGTGCATGCAAAAGGGCTGAAGCTTGAAGTCTATAGTGATGCAGGGTCACAGACATGCAGCAGA
ACTATGCCTGGGTCCCTCGGATATGAACAACATGATGCCAGGCGTTTGCCTCCTGGGGGTTGATTACT
TGAAGTATGACAACTGCAACAACCTGGTACCAGGAAAGTATGCCAAGATGAGCTACGCTCT
TCGGAATTCTGGAAGGAACATTTCTCCCTTTGCAGGGGTGTAGATAACCAGCAACCTGGGCG
AGCGGTCTAGGCAACAGTTGGAGGACGACATCCTACGATAGCTGGGCAGCATGACATCGCGCG
CCGATGAGAACAACAGATGGGCATCCTATGCCGGGCCTGGTTGGAATGATCCAGACATGCTGGAAGT
AGGAAATGTGGCATGTCAAGCGGAGGTATCGATGGGAGTATTTAGTATATGGCATTGGTCAAGGCTCCT
TTGTTGATTGGATGTGATGTGAGGACGATTAGCGGAGATGCATTGGAGATACTGAGCAACTCAGAGGTCA
TTGCGGTCAATCAAGACTACCTTGGAGTTCAGGGAAGAAGGTATTCGGAGGAGCAGCGAAGAGGTTTG
GGCAGGTCGGTTGAGTGGAGGGAAGGTGGCTGTTCCTCTGGAACAGAGGAAGCTCGCGGGCGACGATC
ACAGGAGATGGTCCGACATCGGCCTCTCGTCGGCCTCAGTGTTCGTGATCTTTGGGCGTG
CGACCATCGGGTCTGTTGCGAGGGCAGCTCGCTGCGACGTCGCTCCTCATGCTCCTCATGCGTCGTACGTTCT
GACGCCGCGGTAG (SEQ: 316)
```

FIGURE 3D

```
Seq_Id_No_316_KO_gene_CDS              GACTGCTGATGATGCATTGGTGCATACTGGACTTGCAGGGCTGGGTTATCGCT
Seq_Id_No_317_KO_anticipated_c         GACTGCTGATGATGCATTGGTGCATACTGGACTT-GCAGGGCTGGGTTATCGCT
Seq_Id_No_314_KO_gRNA                  ------------------TGGTGCATACTGGACTTGCA---------------
Seq_Id_No_315_KO_gRNA_after_cu         ------------------TGGTGCATACTGGACTT------------------
                                                         ****************
```

COMPOSITIONS AND METHODS CONFERRING RESISTANCE TO FUNGAL DISEASES

FIELD OF THE INVENTION

The present invention relates to polynucleotides and polypeptides associated with increased resistance of plants towards pathogenic fungi of the genus *Mycosphaerella* and fungi related thereto, particularly towards fungi inducing Sigatoka disease complex and fungi inducing other diseases in *Musa* plant spices, particularly banana; to use thereof for controlling plant diseases associated with the fungal pathogens; and to the production of genetically engineered plants having improved resistance to the pathogenic fungi.

BACKGROUND OF THE INVENTION

Bananas and plantains (*Musa* spp.) are among the top main food crops of the world (right after rice, wheat and maize), with approximately 100 million tons of bananas produced annually in nearly 120 countries in tropical and subtropical regions. However, banana plants are very prone to fungal infections, and the susceptibility is intensified because cultivated banana varieties are closely related genetically, can only be propagated clonally and typically are grown in huge monocultures of genetically identical individuals. Banana cultivars are sterile triploid hybrids (AAA, AAB, ABB) derived from inter- and intraspecific crosses between the wild species *Musa acuminata* (A genome) and *Musa balbisiana* (B genome). These cultivars include dessert bananas (AAA) of the Cavendish subgroup, cooking bananas (AAA or ABB), and nearly all plantain landraces (AAB). Banana fruit of the Cavendish varieties are the main banana exported and consumed in the western world.

The so-called "Sigatoka disease complex" is one of the most destructive diseases in banana worldwide, reducing yields by more than 50%. Three phylogenetically closely related species of *Mycosphaerella* (class Dothideomycetes, order Capnodiales, family Mycosphaerellaceae) have been recognized as the primary constituents of the Sigatoka disease complex in banana, namely *Mycosphaerella fijiensis* (asexual morph: *Pseudocercospora fijiensis*), causal agent of black Sigatoka or black leaf streak disease; *Mycosphaerella musicola* (asexual morph: *Pseudocercospora musae*), causal agent of yellow Sigatoka disease; and *Mycosphaerella eumusae* (asexual morph: *Pseudocercospora eumusae*), causal agent of eumusae leaf spot disease (Arzanlou M et al. Phytopathology. 2007. 97(9):1112-1118). The three *Mycosphaerella* species show significant differences in virulence, but the primary hosts of all three are *Musa* spp.; and all share a common hemibiotrophic and disease cycle on their host, often causing similar and easily confounded symptoms on infected leaves.

The symptoms associated with black Sigatoka caused by *M. fijiensis* include reddish-brown streaks running parallel to the leaf veins, which aggregate to form larger, dark brown to black compound streaks. These streaks eventually form fusiform or elliptical lesions that coalesce, form a water-soaked border with a yellow halo and, eventually, merge to cause extensive leaf necrosis. The disease does not cause immediate death, but weakens the plants by decreasing the leaf area. The decrease in leaf area leads to reduced photosynthetic capacity, which then cause a reduction in the quantity and quality of fruit inducing premature ripening and eventually loss of all produce.

Natural cultivars as well as hybrids that show tolerance or resistance to the Black Sigatoka disease have been reported (e.g. U.S. Plant Patents Nos. PP9791 and PP15863). However, typically these hybrids (being man made or natural) are not suitable for the export market and even in small local markets are not in demand due to poor taste, short shelf life and unattractive appearance. The most important export variety, Cavendish, is very sensitive to the disease.

Currently, the only available measures for preventing or controlling the disease include massive use of fungicides in terms of amounts and frequency of application. Due to the large growing area, fungicides are typically applied from airplanes and as frequent as three times a month, posing hazard both to the environment and to human and animals. Modest estimates claim the direct costs of fungicide applications to be approximately 350M$, growing at 5-10% annually. Another problem is the appearance of fungi strains which are resistant to existing fungicides. Although there is an ongoing attempt to develop new fungicides (e.g. International (PCT) Application Publications Nos. WO 2004/036996; WO 2017/157923), in some areas, even fungicide applications cannot prevent the disease, and plantations are abandoned.

There is an ongoing attempt to produce resistant banana varieties that are also suitable for agricultural growth and produce high quality fruit. However, the triploid nature of the banana genome combined with male and female sterility of the Cavendish variety does not permit conventional breeding. Most of the attempts focused on achieving a triploid hybrid from cross hybridization of a resistant diploid and a sweet banana triploid or tetraploid. However, the few triploid and tetraploid varieties that were generated in breeding programs were not accepted in the international trade as a replacement to the Cavendish banana. Several technologies have been developed in various laboratories worldwide aiming at employing genetic engineering techniques for banana germplasm improvement.

Foreign genes have been successfully introduced to the banana genome attempting to confer resistance to the disease. For example, U.S. Pat. No. 7,534,930 discloses construct system which includes (i) a polynucleotide encoding endochitinase, (ii) a polynucleotide encoding stilbene synthase and (iii) a polynucleotide encoding superoxide dismutase, which, when transformed into cells of banana plants conferred resistance to Sigatoka.

International (PCT) Application Publication No. WO 2004/039993 discloses polynucleotide sequence encoding a pyranosone dehydratase and its use in producing transgenic plants which are resistant to pathogens, particularly fungal pathogens, including *Mycosphaerella fijiensis*. The invention further relates to the in-situ production of one or more antimicrobial compounds, such as microthecin, cortalcerone and/or ascopyrone P (APP) in a host organism, such as a plant.

International (PCT) Application Publication No. WO 2017/103582 discloses nucleic acids and polypeptides which confer fungal disease resistance in plants, in particular, resistance to *Septoria tritici* blotch (STB) disease caused by the ascomycete fungus *Zymoseptona tritici*. The invention further discloses that the identified polynucleotides can be used for the development of improved versions to provide resistance to related fungal plant pathogens including *Mycosphaerella fijiensis* that causes black Sigatoka, which is the most economically important disease of bananas.

Yet there is a great need for new genes that may confer resistance towards the fungi causing the Sigatoka disease complex and towards related fungi and for resistant plants producing high quality yield, particularly banana fruit.

SUMMARY OF THE INVENTION

The present invention answers the above-identified needs, disclosing polynucleotide and polypeptide sequences conferring or enhancing plant resistance towards pathogenic fungi of the genus *Mycosphaerella* and additional pathogenic fungi having similar characteristics, particularly towards *Mycosphaerella fijiensis*, *Mycosphaerella musicola*, and/or *Mycosphaerella* eumusae causing Sigatoka disease complex in plants of the species *Musa* and other *Mycosphaerella* species casing diseases in plants.

The present invention provides isolated polynucleotides and encoded proteins, construct comprising the isolated polynucleotides and methods of use thereof for producing and selecting plants with enhanced resistance to a fungi of the genus *Mycosphaerella* and fungi related thereto and to diseases caused by these fungi. The present invention further provides genetically engineered plants with enhanced resistance to the pathogenic fungi.

According to one aspect, the present invention provides a method for enhancing the resistance of a plant or a part thereof to at least one pathogenic fungus of the genus *Mycosphaerella* and fungi related thereto comprising modulating the expression and/or activity of at least one polypeptide at least 80% identical to a polypeptide having an amino acid sequence selected from the group consisting of SEQ ID NOs:171, 160-170, 172-260 within at least one cell of the plant or part thereof, thereby enhancing the resistance of said plant or part thereof towards the at least one fungus compared to the resistance of a control plant. Each possibility represents a separate embodiment of the present invention.

According to certain embodiments, the method comprises modulating the expression and/or activity of at least one polypeptide having the amino acid sequence selected from the group consisting of SEQ ID NOs:171, 160-170, 172-261. Each possibility represents a separate embodiment of the present invention.

According to certain embodiments, the at least one polypeptide is encoded by a polynucleotide comprising a nucleic acid sequence at least 80% identical to a nucleic acid sequence selected from the group consisting of SEQ ID NOs:54, 72, 43-53, 55-71, 73-155. Each possibility represents a separate embodiment of the present invention.

According to other embodiments, the at least one polypeptide is encoded by a polynucleotide comprising the nucleic acid sequence set for in one any one of SEQ ID NOs:54, 72, 43-53, 55-71, 73-157. Each possibility represents a separate embodiment of the present invention.

According to certain embodiments, enhancing the resistance of the plant or part thereof to the pathogenic fungus comprises enhancing the expression and/or activity of the at least one polypeptide compared to its expression and/or activity in the control plant.

According to certain exemplary embodiments, the polypeptide the expression and/or activity of which is to be enhanced comprises an amino acid sequence at least 80% identical to a polypeptide having an amino acid sequence selected from the group consisting of SEQ ID NOs:171, 160, 163-164, 172, 175-176, 178, 181-182, 189. Each possibility represents a separate embodiment of the present invention.

According to alternative exemplary embodiments, the polypeptide the expression and/or activity of which is to be enhanced comprises an amino acid sequence selected from the group consisting of SEQ ID NOs:171, 160, 163-164, 172, 175-176, 178, 181-182, 189, 261. Each possibility represents a separate embodiment of the present invention.

Enhancing the polypeptide expression can be affected at the genomic and/or the transcript and/or translation level using a variety of methods that induce the transcription and/or translation of the polypeptide.

According to certain embodiments, enhancing the expression and/or activity of the polypeptide comprises introducing into at least one cell of the plant or part thereof an exogenous polynucleotide encoding said polypeptide, thereby producing a transgenic plant over-expressing said polypeptide compared to the control plant.

According to certain embodiments, the exogenous polynucleotide encodes a polypeptide endogenous to the at least one plant cell. According to other embodiments, the exogenous polynucleotide encodes a polypeptide heterologous to the at least one plant cell.

Any method as is known in the art for introducing an exogenous polynucleotide into a plant cell can be used according to the teachings of the present invention.

According to some embodiments, the exogenous polynucleotide is transformed into the plant cell using a suitable vector.

According to some embodiments, genomic editing is employed to edit the genome of the at least one cell as to express a heterologous polynucleotide of the invention.

According to certain embodiments, the polynucleotide the expression of which is to be enhanced comprises a nucleic acid sequence at least 80% identical to a nucleic acid sequence selected from the group consisting of SEQ ID NOs:54, 72, 43, 46-47, 55, 58-59, 61, 64-65, 73, 76-77.

According to other embodiments, the polynucleotide the expression of which is to be enhanced comprises the nucleic acid sequence set forth in one any one of SEQ ID NOs:54, 72, 43, 46-47, 55, 58-59, 61, 64-65, 73, 76-77, 156-157.

According to certain embodiments, enhancing the expression and/or activity of the polypeptide comprises up-regulating the expression of an endogenous polynucleotide encoding said polypeptide within the at least one cell of the plant or part thereof.

According to certain embodiments, the expression is up-regulated by modulating the activity of at least one endogenous regulatory element operably linked to the endogenous polynucleotide. According to some embodiments, the regulatory element is selected from the group consisting of, but not limited to, a promoter and an enhancer.

According to certain embodiments, the expression is up-regulated by introducing at least one isolated polynucleotide which serves as a regulatory element in an appropriate position so as to enhance transcription. According to some exemplary embodiments, the isolated polynucleotide serving as a regulatory element is transformed into the at least one cell of the plant or par thereof using a suitable vector. According to some exemplary embodiments, the isolated polynucleotide serving as a regulatory element is introduced by subjecting the at least one cell of the plant or part thereof to genome editing using artificially engineered nucleases.

According to other embodiments, the expression is up-regulated by inserting at least one mutation within the endogenous polynucleotide and/or a regulatory element operably linked thereto so as to enhance expression of the encoded polypeptide. Any method for mutagenesis as is known in the art can be used according to the teachings of the present invention including chemical mutagenesis, radio-mutagenesis and site directed mutagenesis, for example using genome editing techniques.

According to certain embodiments, enhancing the resistance of the plant to the pathogenic fungus comprises reducing the expression and/or activity of at least one polypeptide compared to its expression and/or activity in the control plant.

Any method as is known in the art for reducing the expression and/or activity of a plant endogenous protein and/or the polynucleotide encoding same can be used according to the teachings of the resent invention.

According to certain embodiments, reducing the expression and/or activity of the polypeptide comprises downregulating the expression of the endogenous polynucleotide encoding said polypeptide within the at least one cell of the plant or part thereof.

According to certain embodiments, reducing the expression and/or activity of the polypeptide comprises modulating the endogenous polynucleotide as to encode a non-functional polypeptide.

According to certain embodiments, expression of the polynucleotide is affected at the genomic and/or the transcript level using a variety of molecules that interfere with transcription and/or translation (e.g., antisense, siRNA, Ribozyme, or DNAzyme) of the polynucleotide. Inserting a mutation or mutations into the polynucleotide, including deletions, insertions, site specific mutations, mutations mediated by artificially engineered nucleases (including zinc-finger nucleases (ZFNs), transcription-activator like effector nucleases (TALENs) and CRISPR/Cas system) can be also used, as long as the mutation(s) result in down-regulation of the gene expression or in the production of non-functional protein.

Alternatively, expression can be inhibited at the protein level using, e.g., antagonists, enzymes that cleave the polypeptide, and the like.

According to some embodiments, the control plant is a plant not manipulated to have modulated expression and/or activity of the polypeptide. According to some embodiments, the control plant is of the same species. According to some embodiments, the control plant comprises the same genetic background.

According to another aspect, the present invention provides a method for producing a population of plants each having an enhanced resistance to at least one pathogenic fungus of the genus *Mycosphaerella* and fungi related thereto comprising the steps of:
(a) modulating the expression and/or activity of at least one polypeptide at least 80% identical to a polypeptide having an amino acid sequence selected from the group consisting of SEQ ID NOs:171, 160-170, 172-260 within at least one cell of each plant of a plant population as to produce a genetically engineered plant population;
(b) inoculating each plant of the genetically engineered plant population with the at least one pathogenic fungus; and
(c) selecting plants showing an enhanced resistance to said pathogenic fungus compared to a control plant or to a pre-determined resistance score value;

thereby producing a population of genetically engineered plants having enhanced resistance to said at least one pathogenic fungus.

According to certain embodiments, the method comprises modulating the expression and/or activity of at least one polypeptide having the amino acid sequence set forth in any one of SEQ ID NOs:171, 160-170, 172-261. Each possibility represents a separate embodiment of the present invention. According to certain embodiments, the method comprises modulating the expression and/or activity of the polypeptide having the amino acid sequence set forth in SEQ ID NO:262.

The expression and/or activity of the at least polypeptide can be enhanced or reduced as described hereinabove.

According to certain embodiments, the method comprises modulating the expression of at least one polynucleotide comprising a nucleic acid sequence at least 80% identical to a polynucleotide having the nucleic acid sequence set forth in any one of SEQ ID NOs:54, 72, 43-53, 55-71, 73-155. According to other embodiments, the method comprises modulating the expression of at least one polynucleotide comprising a nucleic acid sequence having the nucleic acid sequence set forth in any one of SEQ ID NOs:54, 72, 43-53, 55-71, 73-157. According to yet additional embodiments, the method comprises modulating the expression of at least one polynucleotide comprising a nucleic acid sequence having the nucleic acid sequence set forth in any one of SEQ ID NOs:158-159. Each possibility represents a separate embodiment of the present invention.

The expression and/or activity of the at least polynucleotide can be enhanced or reduced as described hereinabove.

According to additional aspect, the present invention provides a method for selecting a plant having an enhanced resistance to at least one pathogenic fungus of the genus *Mycosphaerella* and fungi related thereto, comprising the steps of:
(a) providing a plurality of plants, each comprising at least one cell with modulated expression and/or activity of a polypeptide at least 80% identical to a polypeptide having an amino acid sequence selected from the group consisting of SEQ ID NOs:171, 160-170, 172-260;
(b) inoculating the plurality of plants with the at least one pathogenic fungus; and
(c) selecting plants showing an enhanced resistance to said at least one pathogenic fungus compared to a control plant or to a pre-determined resistance score value.

According to certain embodiments, the method comprises providing a plurality of plants each having a modulated expression and/or activity of at least one polypeptide having an amino acid sequence selected from the group consisting of SEQ ID NOs:171, 160-170, 172-261. Each possibility represents a separate embodiment of the present invention. According to certain embodiments, the method comprises providing a plurality of plants each having a modulated expression and/or activity of a polypeptide having the amino acid sequence of SEQ ID NO:262.

According to certain embodiments, the modulated expression and/or activity is selected from enhanced expression and/or activity and reduced expression and/or activity. Modulating the expression can be performed by any method as is known in the Art and as described hereinabove.

According to certain embodiments, the method comprises modulating the expression of at least one polynucleotide comprising a nucleic acid sequence at least 80% identical to a polynucleotide having the nucleic acid sequence set forth in any one of SEQ ID NOs:54, 72, 43-53, 55-71, 73-155. According to other embodiments, the method comprises modulating the expression of at least one polynucleotide comprising a nucleic acid sequence having the nucleic acid sequence set forth in any one of SEQ ID NOs:54, 72, 43-53, 55-71, 73-157. According to yet additional embodiments, the method comprises modulating the expression of at least one polynucleotide comprising a nucleic acid sequence having the nucleic acid sequence set forth in any one of SEQ ID NOs:158-159. Each possibility represents a separate embodiment of the present invention.

According to certain embodiments, the control plant is a plant not engineered to have modulated expression and/or activity of the at least one polypeptide of the invention. According to some embodiments, the control plant is of the same species. According to some embodiments, the control plant comprises the same genetic background.

According to certain embodiments, the pre-determined resistance score value is obtained by a method comprising the steps of inoculating a plurality of corresponding plants susceptible to the at least one pathogenic fungus; scoring the infection degree; and setting an average resistance score value.

According to certain embodiments, the plant part is selected from the group consisting of seeds, leaves, roots, shoots, ovules, pollen, flowers and the like. Each possibility represents separate embodiment of the present invention. According to certain exemplary embodiments, the plant part is a leaf Tissue cultures comprising cells derived from the plant having an enhanced expression and/or activity of a polypeptide of the invention are also encompassed within the scope of the present invention.

According to additional aspect, the present invention provides a genetically engineered plant having enhanced resistance to at least one fungus of the genus *Mycosphaerella* and fungi related thereto compared to a non-engineered control plant, the genetically engineered plant comprising at least one cell having modified expression and/or activity of at least one polypeptide at least 80% identical to a polypeptide having an amino acid sequence selected from the group consisting of SEQ ID NOs:171, 160-170, 172-260 compared to the polypeptide expression and/or activity in the non-engineered control plant. Each possibility represents a separate embodiment of the present invention.

According to certain embodiments, the genetically engineered plant comprises at least one cell having modified expression and/or activity of at least one polypeptide having the amino acid sequence selected from the group consisting of SEQ ID NOs:171, 160-170, 172-261. Each possibility represents a separate embodiment of the present invention.

According to certain embodiments, the genetically engineered plant comprises at least one cell having modified expression of a polynucleotide encoding the at least one polypeptide.

According to certain embodiments, the at least one polypeptide is encoded by a polynucleotide at least 80% identical to a nucleic acid sequence selected from the group consisting of SEQ ID NOs:54, 72, 43-53, 55-71, 73-155. According to some embodiments, the at least one polypeptide is encoded by a polynucleotide having the nucleic acid sequence selected from the group consisting of SEQ ID NOs:54, 72, 43-53, 55-71, 73-157.

According to certain exemplary embodiments, the genetically engineered plant having enhanced resistance to the at least one fungus comprises at least one cell with enhanced expression and/or activity of at least one polypeptide at least 80% identical to an amino acid sequence selected from the group consisting of SEQ ID NOs:171, 160, 163-164, 172, 175-176, 178, 181-182, 189. According to additional exemplary embodiments, the at least one polypeptide comprises the amino acid sequence set forth in any one of SEQ ID NOs:171, 160, 163-164, 172, 175-176, 178, 181-182, 189, 261. Each possibility represents a separate embodiment of the present invention.

According to certain embodiments, the genetically engineered plant having enhanced resistance to the at least one fungus comprises at least one cell with enhanced expression of a polynucleotide encoding the at least one polypeptide. According to certain exemplary embodiments, the polynucleotide expression in the genetically engineered plant is enhanced in comparison to the polynucleotide expression in a control plant.

According to certain exemplary embodiments, the genetically engineered plant having enhanced resistance to the at least one fungus comprises at least one cell with enhanced expression of at least one polynucleotide at least 80% identical to a nucleic acid sequence selected from the group consisting of SEQ ID NOs:54, 72, 43, 46-47, 55, 58-59, 61, 64-65, 73, 76-77. According to additional exemplary embodiments, the at least one polynucleotide comprises the nucleic acid sequence set forth in any one of SEQ ID NOs:54, 72, 43, 46-47, 55, 58-59, 61, 64-65, 73, 76-77, 156-157. Each possibility represents a separate embodiment of the present invention.

According to certain embodiments, the genetically engineered plant comprises at least one cell transformed with an exogenous polynucleotide encoding the at least one polypeptide, thereby having an enhanced resistance to the at least one fungus. The exogenous polynucleotide can be endogenous to the plant cell or heterologous to the plant cell.

According to certain embodiments, the genetically engineered plant comprises at least one cell edited to express an exogenous polynucleotide encoding the at least one polypeptide, thereby having an enhanced resistance to the at least one fungus.

According to certain embodiments, the genetically engineered plant comprises at least one cell edited to overexpress an endogenous polynucleotide encoding the at least one polypeptide, thereby having an enhanced resistance to the at least one fungus.

According to certain embodiments, the genetically engineered plant having enhanced resistance to the at least one fungus comprises at least one cell with reduced expression and/or activity of at least one polypeptide in comparison to the polypeptide expression and/or activity in a control plant.

According to certain embodiments, the genetically engineered plant having reduced expression and/or activity of the at least one polypeptide comprises at least one cell having reduced expression of a polynucleotide encoding said at least one polypeptide, thereby having an enhanced resistance to the at least one fungus. According to some embodiments, reducing the expression of a polynucleotide encoding said at least one polypeptide comprises knock down or knock out of the gene using genome editing techniques.

According to certain embodiments, the genetically engineered plant comprises a polynucleotide encoding a modified form of the at least one polypeptide, wherein the modified form has reduced or no activity compared to the unmodified form, thereby having an enhanced resistance to the at least one fungus.

According to additional aspect, the present invention provides an isolated polynucleotide encoding a polypeptide comprising an amino acid sequence at least 80% identical to an amino acid sequence selected from the group consisting of SEQ ID NOs:171, 160, 163-164, 172, 175-176, 178, 181-182, 189, wherein the polypeptide, when expressed in a plant, is capable of enhancing the resistance of the plant to at least one pathogenic fungus of the genus *Mycosphaerella* and fungi related thereto.

According to certain embodiments, the polynucleotide encodes a polypeptide comprising the amino acid sequence set forth in any one of SEQ ID NOs:171, 160, 163-164, 172, 175-176, 178, 181-182, 189, 261.

According to certain embodiments, the polynucleotide comprises a nucleic acid sequence at least 80% identical to a nucleic acids sequence set forth in any one of SEQ ID NOs:54, 72, 43, 46-47, 55, 58-59, 61, 64-65, 73, 76-77. According to other embodiments, the polynucleotide comprises the nucleic acid sequence set forth in any one of SEQ ID NOs:54, 72, 43, 46-47, 55, 58-59, 61, 64-65, 73, 76-77, 156-157.

According to yet another aspect, the present invention provides an isolated polynucleotide, a fragment or a mutant thereof, the polynucleotide comprising a nucleic acid sequence at least 80% identical to a nucleic acids sequence selected from the group consisting of SEQ ID NOs:54, 72, 43-53, 55-71, 73-155, wherein the polynucleotide, when expressed in a plant, is capable of enhancing the resistance of the plant to at least one pathogenic fungus of the genus *Mycosphaerella* and fungi related thereto. According to certain embodiments, the polynucleotide comprises the nucleic acid sequence set forth in any one if SEQ ID NOs:54, 72, 43-53, 55-71, 73-157.

According to additional aspect, the present invention provides a nucleic acid construct comprising a polynucleotide according to some embodiments of the present invention, further comprising at least one regulatory element for directing the expression of the polynucleotide within a plant cell. According to certain embodiment, the regulatory element is a promoter. The promoter can be endogenous or heterologous to the plant comprising the nucleic acid construct.

The polypeptides and polynucleotides disclosed herein may be used to confer resistance to pathogenic fungi of the genus *Mycosphaerella* and fungi related thereto that cause commercial damage to crop and ornamental plants.

According to certain embodiments, the at least one fungus of the genus *Mycosphaerella* is selected from the group consisting of *M. fijiensis, M. musicola, M. eumusae, M. graminicola, M. caffeicola, M. zeae maydis, M. areola, M. linicola, M. brassicola, M. cryptic, M. platanicola, M. citri, M. pomi, M. fragariae, M. rosicola* and any combination thereof. Each possibility represents a separate embodiment of the present invention.

According to certain embodiments, the at least one fungus related to the *Mycosphaerella* genus is selected from the group consisting of *Fusarium oxysporum* f. sp. *Cubense, Fusarium pallidoroseum, Colletotrichum musae, Verticillium theobromae, Cylindrocarpon musae, Pestalotiopsis disseminate, Curvularia eragrostidis, Cercospora hayi, Pestalotiopsis leprogena*, and any combination thereof.

Any plant that may be negatively affected by the pathogenic fungi, including monocotyledonous and dicotyledonous plants can be modified to show enhanced resistance according to the teachings of the present invention.

According to certain embodiments, the plant is selected from the group consisting of a plant of the genus *Musa*; wheat; maize; cotton; flax; plants of the Brassicaceae family (including cauliflower, Brussel sprouts and cabbage); strawberry; rose; a tree of the genus *Citrus* (including lemon, grapefruit, mandarin, kumquats and navel orange), *Coffea* species, Eucalyptus, *Platanus* species and Apple.

According to some embodiments, the plant is of the *Musa* species and the at least one fungus is selected from the group consisting of *M. fijiensis, M. musicola, M. eumusae, Fusarium oxysporum* f. sp. *Cubense, Fusarium pallidoroseum, Colletotrichum musae, Verticillium theobromae, Cylindrocarpon musae, Pestalotiopsis disseminate, Curvularia eragrostidis, Cercospora hayi, Pestalotiopsis leprogena*, and any combination thereof. Each possibility represents a separate embodiment of the present invention.

According to certain exemplary embodiments, the plant is of the *Musa* species and the at least one fungus is selected from the group consisting of *M. fijiensis, M. musicola* and *M. eumusae*.

Other objects, features and advantages of the present invention will become clear from the following description and drawings.

BRIEF DESCRIPTION OF THE FIGURES

FIG. 2 depicts an exemplary design for over expression of the banana BAN8 by Homology Directed Repair according to some embodiments of the invention. FIG. 2A depicts the sequence of the endogenous 5' upstream flanking region of the target genomic sequence (SEQ ID NO:308). FIG. 2B depicts the sequence of the endogenous 3'-downstream flanking region of this genomic locus (SEQ ID NO:309). FIG. 2C depicts the sequence of the 5'-UTR gRNA (SEQ ID NO:306). FIG. 2D depicts the sequence of the 5'-UTR gRNA without NGG nucleotides following the 3 nucleotides after the Cas9 cutting (SEQ ID NO:310). FIG. 2E depicts the sequence of the 3'-UTR gRNA (SEQ ID NO:307). FIG. 2F depicts the sequence of the 3'-UTR gRNA after cut (SEQ ID NO:311). FIG. 2G depicts the coding sequence (from the "ATG" start codon to the "TAA" termination codon, marked by bold and underlined) of the desired BAN8 sequence (SEQ ID NO:313) encoding the polypeptide set forth by SEQ ID NO:46. FIG. 2H depicts the exemplary repair template (SEQ ID NO:312) which includes (1) the upstream flanking region (1 kbp) sequence including part of the gRNA after cutting (SEQ ID NO:310; shown in bold and italics); (2) 5' UTR of genomic DNA from Cas9 cutting site to ATG; (3) the coding sequence (CDS) of the desired BAN8 sequence (SEQ ID NO:313) with the start (ATG) and the stop (TAA) codons marked in bold and underlined; (4) 3' UTR of genomic DNA from the stop codon to Cas9 cutting site including the predicted part of the gRNA after cutting (SEQ ID NO:311), shown in bold and italics and (5) the downstream flanking region (1 kbp) sequence.

FIG. 3 depicts an exemplary design of polynucleotide knockout (KO) using CRISPR/CAS system. FIG. 3A depicts the sequence of the KO gRNA (SEQ ID NO:314). FIG. 3B depicts the sequence of the KO gRNA after cut (SEQ ID NO:315). FIG. 3C depicts the coding sequence (from the "ATG" start codon to the "TAG" termination codon, marked by bold and underlined) of the desired BAN29 sequence (SEQ ID NO:316). FIG. 3D depict the coding sequence of the KO anticipated change (SEQ ID NO:317).

DETAILED DESCRIPTION OF THE INVENTION

Figure 1:
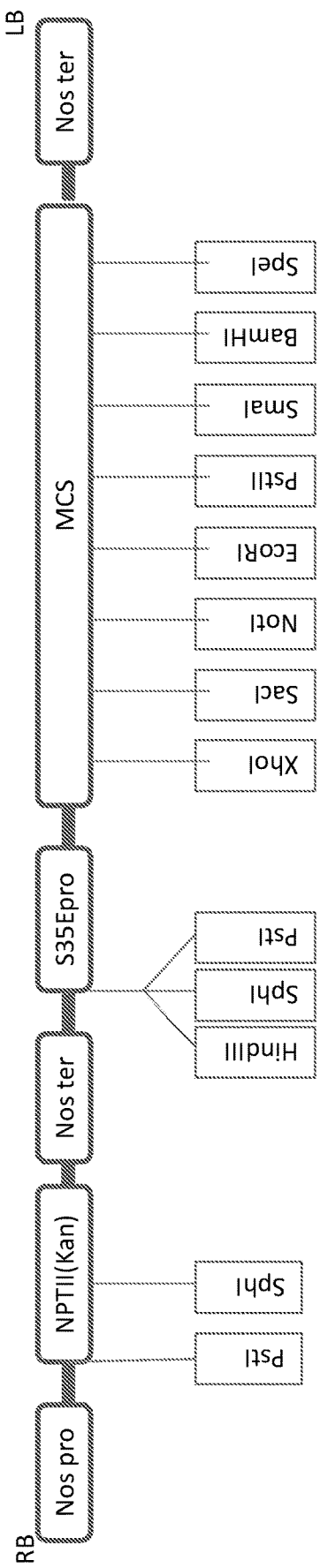
FIG. 1 shows a schematic illustration of the tDNA plasmids used for cloning and expression of selected gene in banana plants (Example 5 hereinbelow). "RB"=right border; "LB"=left border; "NOS pro"=nopaline synthase promoter; "NPTII"=neomycin phosphotransferase II; "NOS ter"=nopaline synthase terminator; "35SEpro"=35S promoter; The isolated polynucleotide sequences of some embodiments of the invention were cloned into the Multiple Cloning Site (MCS) of the vector using one or more of the indicated restriction enzyme sites.

The present invention discloses means and methods for conferring and/or enhancing the resistance of a plant to pathogenic fungi of the genus *Mycosphaerella* and fungi related thereto. Particularly, the present invention provides isolated polypeptides conferring or enhancing plant resistance towards the pathogenic fungi, isolated polynucleotides encoding same, nucleic acid constructs and plant cells transformed with same and methods for producing and selecting plants having increased resistance to at least one of the pathogenic fungi.

The present invention is based in part on bioinformatics tools that have been used to identify polynucleotides associated with resistance or reduced sensitivity of plants to at least one pathogenic fungus of the genus *Mycosphaerella*, particularly to fungi causing Sigatoka disease complex and other *Mycosphaerella* fungi pathogenic to crop plant, as well as to fungi related to *Mycosphaerella* which are pathogenic to plant of the species *Musa*. Several plants including banana (*Musa*), maize (*Zea*), wheat (*Triticum*) and rice (*Oriza*) were used as representative genera to identify genes overexpressed in plants showing modified resistance to the fungi infection, and genes comprising the nucleic acids sequence set forth in any one of SEQ ID NOs:43-60, 156, encoding polypeptides having the amino acid sequence set forth in any one of SEQ ID NOs:160-177, 261 were identified.

Homologous genes and encoded proteins were also identified in wider genera of plant, as described in details and presented in Table 2 hereinbelow. Polynucleotides according to some embodiments of the present invention were cloned into binary vectors (Example 5, Table 7), and further transformed into Banana (*Musa acuminata*) plants (Examples 6 and 7 hereinbelow) to further validate the effect of the genes on the resistance of the transformed towards *Mycosphaerella*.

Definitions

The terms "comprise", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible sub ranges as well as individual numerical values within that range. For example, description of a range such as from 1 to 6 should be considered to have specifically disclosed sub ranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the agricultural, chemical, pharmacological, biological, biochemical and medical arts.

As used herein, the term "resistance" with regard to plants pathogenic fungus, particularly to plant pathogenic fungus of the genus *Mycosphaerella* and fungi related thereto refers to a plant that is resistant to infection by a fungal pathogen or resistant to the symptoms of fungal pathogen infection. For example, a plant resistant to a fungal pathogen can exhibit a lack of infection, or reduced symptoms of infection, when challenged with a pathogen. As another example, a plant resistant to a fungal pathogen can be infected by the fungal pathogen and yet exhibit a reduced number or degree of symptoms of said infection. As yet another example, a plant resistant to a fungal pathogen can be infected by the pathogen and exhibit one or more symptoms of infection by the pathogen and yet exhibit a reduction in an effect of the infection or symptom thereof. For instance, a plant resistant to a fungal pathogen can be infected by the pathogen, and exhibit one or more symptoms associated with the fungal disease, for example leaf necrosis, and yet exhibit a reduction in yield loss in comparison to a plant that is not resistant to the fungal pathogen.

Accordingly, "confer resistance to a pathogenic fungus" or "enhanced resistance to a pathogenic fungus" refer to a phenotype in which a plant has greater health, growth, multiplication, fertility, vigor, strength (e.g., lodging resistance), yield, or less severe symptoms associated with infection of the pathogenic fungus during or after a fungal infection than an organism that does not have enhanced resistance to the pathogen. Where a plant is tested for resistance, a control plant is used to assess the degree of the plant resistance. According to certain embodiments of the present invention, the control plant is a plant not manipulated to have modified expression of at least one polypeptide of the present invention. The control plant is typically, but not necessarily of the same species as the examined plant. According to some embodiments the control plant is of the same specifies and has the same genetic background as the examined plant. The enhancement can be an increase of 0.1%, 0.2%, 0.3%, 0.5%, 0.75%, 1%, 1.5%, 2%, 3%, 4%, 5%, 6%, 7%, 8%, 9%, 10%, 12%, 15%, 17%, 20%, 25%, 30%, 35%, 40%, 50%, 60%, 70%, 80%, 90%, 100%, or more in health, growth, multiplication, fertility, vigor, strength (e.g., lodging resistance), or yield, as compared to a control plant. The enhancement can be a decrease of 0.1%, 0.2%, 0.3%, 0.5%, 0.75%, 1%, 1.5%, 2%, 3%, 4%, 5%, 6%, 7%, 8%, 9%, 10%, 12%, 15%, 17%, 20%, 25%, 30%, 35%, 40%, 50%, 60%, 70%, 80%, 90%, or 100% in the symptoms associated with the pathogenic fungus as compared to the control plant. According to certain exemplary embodiments, the examined plant and the control plant are grown under the same conditions.

As used herein, the terms "modulation", "modulating" "modulated" and the like with reference to expression or activity of a polynucleotide, gene, polypeptide or protein refers to any change, modification or alteration in the expression or activity within a plant cell or a plurality of plant cell compared to the expression or activity of the polynucleotide, gene, polypeptide or protein in a control plant. The control plant is a plant in which the expression has not been modulated by man, and can be of the same or another species. When the control plant is of the same species it can comprise the same genetic background, or even be the same plant before modulation took place.

According to certain embodiments of the invention, enhancing the resistance of a plant to a pathogenic fungus comprises enhancing the expression and/or activity of a polypeptide of the invention within at least one cell of the plant. As used herein, the expression of a polynucleotide or polypeptide of the invention is "enhanced" or "up-regulated" if the level of the polynucleotide or polypeptide is enhanced by at least 50%, i.e. the polynucleotide or polypeptide level is at least 1.5-fold higher compared to its level in a control plant or compared to a predetermined threshold level. According to some embodiments, the level of the polynucleotide or polypeptide is enhanced by at least 60%, 70%, 80%, 90%, 100%, 200%, 300% and more.

According to certain embodiments of the invention, enhancing the resistance of a plant to a pathogenic fungus comprises reducing the expression and/or activity of a polypeptide of the invention within at least one cell of the plant. As used herein, the expression of a polynucleotide or polypeptide of the invention is "reduced", "inhibited", "down regulated" or "knocked down" if the level of the polynucleotide or polypeptide is reduced by at least 30% compared to its level in a control plant or compared to a predetermined threshold level. According to certain embodiments, the level of the polynucleotide or polypeptide is reduced by at least 40%, 50%, 60%, 70%, 80%, 90% and more. According to some embodiments, the term "reduced expression" refers to 100% inhibition or "knockout" of a polynucleotide function and/or expression.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

The term "isolated" refers to at least partially separated from the natural environment e.g., from a plant cell.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

It should be noted that the nucleic acid sequence of a polynucleotide encoding a polypeptide which is provided in the sequence listing as a single strand refers to the sense direction which is equivalent to the mRNA transcribed from the polynucleotide.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

As used herein, the phrase "exogenous polynucleotide" refers to a heterologous nucleic acid sequence which is not naturally expressed within the plant (e.g., a nucleic acid sequence from a different species) or to an endogenous nucleic acid of which overexpression in the plant is desired. The exogenous polynucleotide may be introduced into the plant in a stable or transient manner, so as to produce a ribonucleic acid (RNA) molecule and/or a polypeptide molecule. The term "endogenous" as used herein refers to a polynucleotide or polypeptide which is naturally present and/or naturally expressed within a plant or a cell thereof.

The term "heterologous" as used herein refers to polynucleotide or polypeptide which is not naturally present and/or naturally expressed within a plant or a cell thereof.

According to one aspect the present invention provides a method for enhancing the resistance of a plant or a part thereof to at least one pathogenic fungus of the genus *Mycosphaerella* and fungi related thereto comprising modulating the expression and/or activity of at least one polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%. at least about 96%. at least about 97%. at least about 98%. at least about 99% or more homologous to, or identical to a polypeptide having an amino acid sequence selected from the group consisting of SEQ ID NOs:160-260 within at least one cell of the plant or part thereof, thereby enhancing the resistance of said plant or part thereof towards the at least one fungus compared to the resistance of a control plant. Each possibility represents a separate embodiment of the present invention.

According to additional aspect, the present invention provides a method for enhancing the resistance of a plant or a part thereof to at least one pathogenic fungus of the genus *Mycosphaerella* and fungi related thereto comprising modulating the expression of at least one polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polypeptide having an amino acid sequence selected from the group consisting of SEQ ID NOs:160-260 within at least one cell of the plant or part thereof, thereby enhancing the resistance of said plant or part thereof towards the at least one fungus compared to the resistance of a control plant. Each possibility represents a separate embodiment of the present invention.

According to certain embodiments, the polypeptide is 80%-99% homologous to any one of the polypeptides set forth in SEQ ID NOs:160-260. According to other embodiments, the polypeptide is 85%-95% homologous to any one of the polypeptides set forth in SEQ ID NOs:160-260. According to other embodiments, the polypeptide is 90%-99% homologous to any one of the polypeptides set forth in SEQ ID NOs:160-260. According to certain embodiments, the polypeptide comprises an amino acid sequence selected from the group consisting of SEQ ID NOs:160-261. Each possibility represents a separate embodiment of the present invention. According to certain embodiments, the polypeptide consists of the amino acid sequence selected from the group consisting of SEQ ID NOs:160-261. Each possibility represents a separate embodiment of the present invention.

According to additional aspect, the present invention provides a method for enhancing the resistance of a plant or a part thereof to at least one pathogenic fungus of the genus *Mycosphaerella* and fungi related thereto comprising modulating the expression of at least one polynucleotide comprising a nucleic acid sequence at least about 80%, at least about 81%, at least about 82%, at least about 83%. at least about 84%. at least about 85%, at least about 86%, at least about 87%. at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polynucleotide having the nucleic acid sequence selected from the group consisting of SEQ ID NOs:43-155 within at least one cell of the plant or part thereof, thereby enhancing the resistance of said plant or part thereof towards the at least one fungus compared to the resistance of a control plant. Each possibility represents a separate embodiment of the present invention.

According to certain embodiments, the polynucleotide is 80%-99% homologous to any one of the polynucleotides set forth in SEQ ID NOs:43-155. According to other embodiments, the polynucleotide is 85%-95% homologous to any one of the polynucleotides set forth in SEQ ID NOs:43-155. According to other embodiments, the polynucleotide is 90%-99% homologous to any one of the polynucleotides set forth in SEQ ID NOs:43-155.

According to other embodiments, the polynucleotide comprises the nucleic acid sequence set for the one any one of SEQ ID NOs:43-157. Each possibility represents a separate embodiment of the present invention. According to additional embodiments, the polynucleotide consists of the nucleic acid sequence set for the one any one of SEQ ID NOs:43-157. Each possibility represents a separate embodiment of the present invention.

According to another aspect, the present invention provides a method for producing a population of plants each having an enhanced resistance to at least one pathogenic fungus of the genus *Mycosphaerella* and fungi related thereto comprising the steps of:
(a) modulating the expression and/or activity of at least one polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polypeptide having an amino acid sequence selected from the group consisting of SEQ ID NOs:160-260 within at least one cell of each plant of a plant population as to produce a genetically engineered plant population;
(b) inoculating each plant of the genetically engineered plant population with the at least one pathogenic fungus; and
(c) selecting plants showing an enhanced resistance to said at least one pathogenic fungus compared to a control plant or to a pre-determined resistance score value;
thereby producing a population of genetically engineered plants having enhanced resistance to said at least one pathogenic fungus.

According to certain embodiments, the method comprises modulating the expression and/or activity of at least one polypeptide having the amino acid sequence set forth in any one of SEQ ID NOs:160-262. According to certain embodiments, the method comprises modulating the expression and/or activity of the amino acid sequence set forth in SEQ ID NO:262. According to certain embodiments, the method comprises modulating the expression and/or activity of at least one polypeptide consisting of the amino acid sequence set forth in any one of SEQ ID NOs:160-262.

According to certain embodiments, enhancing the resistance of the plant or part thereof to the pathogenic fungus comprises enhancing or reducing the expression and/or activity of the at least one polypeptide compared to its expression and/or activity in the control plant.

According to additional aspect, the present invention provides a method for selecting a plant having an enhanced resistance to at least one pathogenic fungus of the genus *Mycosphaerella* and fungi related thereto, comprising the steps of:
(a) providing a plurality of plants each comprising at least one cell with modulated expression and/or activity of a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polypeptide having an amino acid sequence selected from the group consisting of SEQ ID NOs:160-260 compared to a control cell;
(b) inoculating the plurality of plants with the at least one pathogenic fungus; and
(c) selecting plants showing an enhanced resistance to said at least one pathogenic fungus compared to the control plant or to a pre-determined resistance score value.

According to certain embodiments, the method comprises providing a plurality of plants each comprising at least one cell with modulated expression and/or activity of at least one polypeptide having the amino acid sequence set forth in any one of SEQ ID NOs:160-262. According to certain embodiments, the at least one polypeptide comprises the amino acid sequence set forth in any one of SEQ ID NO:262. According to some embodiments, the at least one polypeptide consists of the amino acid sequence set forth in any one of SEQ ID NOs:160-262.

The plurality of plants having modulated expression and/or activity of the polypeptide may include plants having at least one cell with enhanced expression and/or activity of the polypeptide, plants having at least one cell with reduced expression and/or activity of the polypeptide or a combination thereof. Enhancing or reducing the expression and/or activity of the polypeptide can be performed as is known in the Art and as described hereinbelow.

According to another aspect, the present invention provides a method for conferring and/or enhancing the resistance of a grafted plant to at least one pathogenic fungus of the genus *Mycosphaerella* and fungi related thereto, the method comprises providing a scion and a rootstock, wherein the rootstock has enhanced resistance to the at least one pathogenic fungi, said rootstock comprises at least one cell with a modulated expression and or activity of a polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to the amino acid sequence selected from the group consisting of SEQ ID NOs:160-260 compared to the expression in the scion, and grafting said scion onto said rootstock, thereby producing a grafted plant having an enhanced resistance to said at least one pathogenic fungus of the genus *Mycosphaerella* and fungi related thereto.

According to another aspect, the present invention provides a method for conferring and/or enhancing the resistance of a grafted plant to at least one pathogenic fungus of the genus *Mycosphaerella* and fungi related thereto, the method comprising providing a scion having enhanced resistance to the at least one pathogenic fungi and a rootstock, wherein the scion comprises at least on cell having modulated expression of a polynucleotide encoding a polypeptide about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%. at least about 95%. at least about 96%, at least about 97%. at least about 98%. at least about 99% or more homologous, or identical to the amino acid sequence selected from the group consisting of SEQ ID NOs:160-260 compared to the rootstock, and grafting said scion onto said rootstock, thereby producing a grafted plant having an enhanced resistance to said at least one pathogenic fungus of the genus *Mycosphaerella* and fungi related thereto.

According to certain embodiments, the polypeptide with modified expression in the scion or in the rootstock comprises an amino acid sequence selected from the group consisting of SEQ ID NOs:160-261.

According to certain embodiments, the scion or rootstock having enhanced resistance to the at least one fungus comprises at least one cell with enhanced expression and/or activity of the at least one polypeptide or the nucleotide encoding same. According to other embodiments, the scion or rootstock having enhanced resistance to the at least one fungus comprises at least one cell with reduced expression and/or activity of the at least one polypeptide or the nucleotide encoding same.

According to certain embodiments, the rootstock or the scion having enhanced resistance to the at least one fungi over-expresses a polynucleotide about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to a nucleic acid sequence set forth in any one of SEQ ID NOs:43-155 compared to the corresponding rootstock or scion with non-modulated expression. According to some embodiments, the polynucleotide over-expressed in the rootstock or the scion comprises a nucleic acid sequence selected from the group consisting of SEQ ID NOs:43-157. According to some embodiments, the at least one polynucleotide is constitutively over-expressed in the rootstock or scion. According to some embodiments, the at least one polynucleotide is over-expressed in the rootstock or scion in a tissue specific or inducible manner. According to some embodiments, the expression of the at least one polynucleotide is induced by biotic stress, particularly by fungi infection.

According to additional aspect, the present invention provides a method of growing a crop plant having enhanced resistance to at least one pathogenic fungus of the genus *Mycosphaerella and fungi related thereto, the method comprising the steps of:*

(a) selecting a parent plant having a modulated expression of at least one exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to the amino acid sequence selected from the group consisting of SEQ ID NOs:43-155 for enhanced resistance to the at least one pathogenic fungus compared to the control plant; and
 (b) growing a progeny crop plant of the parent plant, wherein the progeny crop plant having modulated expression of the exogenous polynucleotide has an enhanced resistance to said at least one pathogenic fungus of the genus *Mycosphaerella* and fungi related thereto.

According to certain embodiments, the encoded polypeptide comprises the amino acid sequence set forth in any one of SEQ ID NOs:160-262. According to some embodiments, the encoded polypeptide consists of the amino acid sequence set forth in any one of SEQ ID NOs:160-262.

According to certain embodiments, the polynucleotide comprises a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a nucleic acid sequence set forth in any one of SEQ ID NOs:43-155.

According to certain embodiments, the polynucleotide comprises the nucleic acid sequence set forth in any one of SEQ ID NOs:43-159. According to some embodiments, the polynucleotide consists of the nucleic acid sequence set forth in any one of SEQ ID NOs:43-159.

According to certain embodiments, the modulated expression of the least one exogenous polynucleotide comprises up-regulation of said polynucleotide expression. According to certain embodiments, the modulated expression of the least one exogenous polynucleotide comprises down-regulation of said polynucleotide expression.

According to certain exemplary embodiments of the present invention, the at least one polypeptide the expression of which is modulated to be upregulated comprises an amino acid sequence at least 80% identical to a polypeptide having an amino acid sequence selected from the group consisting of SEQ ID NOs:160, 163-164, 171-172, 175-176, 178, 181-182, 189. According to additional exemplary embodiments, the at least one polypeptide comprises the amino acid sequence set forth in any one of SEQ ID Nos:160, 163-164, 171-172, 175-176, 178, 181-182, 189, 261. Each possibility represents a separate embodiment of the present invention. According to some embodiments, the at least one polypeptide is encoded by a polynucleotide having a nucleic acids sequence at least 80% identical to a nucleic acid sequence selected from the group consisting of SEQ ID NOs:43, 46-47, 54-55, 58-59, 61, 64-65, 72-73, 76-77. According to some embodiments, the polynucleotide comprises the nucleic acid sequence set forth in any one of SEQ ID NOs:43, 46-47, 54-55, 58-59, 61, 64-65, 72-73, 76-77, 156-157. Each possibility represents a separate embodiment of the present invention.

According to yet additional aspect, the present invention provides a method of producing seeds of a crop comprising the steps of:

(a) selecting a parent plant having a modulated expression of at least one exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to the amino acid sequence selected from the group consisting of SEQ ID NOs:160-260 for enhanced resistance to at least one pathogenic fungus of the genus *Mycosphaerella* and fungi related thereto compared to a control plant;

(b) growing the selected parent plant of step (a) to produce seeds;

(c) harvesting the produced seeds.

According to certain embodiments, the modulated expression of the least one exogenous polynucleotide comprises up-regulation of said polynucleotide expression. According to certain embodiments, the modulated expression of the least one exogenous polynucleotide comprises down-regulation of said polynucleotide expression.

According to some embodiments, the parent plant is transformed with at least one polynucleotide comprising the nucleic acid sequence set forth in any one of SEQ ID NOs:43, 46-47, 54-55, 58-59, 61, 64-65, 72-73, 76-77, 156-157, thereby the expression of the polynucleotide is up-regulated. According to some embodiments, the polynucleotide consists of the nucleic acid sequence set forth in any one of SEQ ID NOs:43, 46-47, 54-55, 58-59, 61, 64-65, 72-73, 76-77, 156-157. Each possibility represents a separate embodiment of the present invention.

According to certain embodiments, the seeds produced by the method of the invention comprise the at least one exogenous polynucleotide. According to some embodiments, plants grown from the produced seed have enhanced resistance to at least pathogenic fungus of the genus *Mycosphaerella* and fungi related thereto.

The present invention encompasses polynucleotides identified to be associated with resistance to at least one pathogenic fungus of the genus *Mycosphaerella* and fungi related thereto, polypeptides encoded by same and homologs thereto.

According to certain embodiments, the exogenous polynucleotides employed in the methods of the present invention encode a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to an amino acid sequence set forth in any one of SEQ ID NOs:160-177, 261.

According to certain embodiments, the exogenous polynucleotides employed in the methods of the present invention comprise a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a nucleic acid sequence set forth in any one of SEQ ID NOs:43-60, 156.

Homologous sequences include both orthologous and paralogous sequences. The term "paralogous" relates to gene-duplications within the genome of a species leading to paralogous genes. The term "orthologous" relates to homologous genes in different organisms due to ancestral relationship. Thus, orthologs are evolutionary counterparts derived from a single ancestral gene in the last common ancestor of given two species (Koonin E V and Galperin M Y 2003. Sequence—Evolution—Function: Computational Approaches in Comparative Genomics. Boston: Kluwer Academic; Chapter 2, Evolutionary Concept in Genetics and Genomics) and therefore have great likelihood of having the same function.

One option to identify orthologues in monocot or in dicot plant species is by performing a reciprocal blast search. This may be done by a first blast involving blasting the sequence-of-interest against any sequence database, such as the publicly available NCBI database which may be found at: ncbi.nlm.nih.gov. If orthologues in rice were sought, the sequence-of-interest would be blasted against, for example, the 28,469 full-length cDNA clones from *Oryza sativa* Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used (ebi.ac.uk/Tools/clustalw2/index.html), followed by a neighbor-joining tree (Wikipedia.org/wiki/Neighbor-joining) which helps visualizing the clustering.

Homology (e.g., percent homology, sequence identity+ sequence similarity) can be determined using any homology comparison software computing a pairwise sequence alignment.

As used herein, "sequence identity" or "identity" in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff J G. (Amino acid substitution matrices from protein blocks. Proc. Natl. Acad. Sci. U.S.A. 1992, 89(22): 10915-9).

Identity (e.g., percent homology) can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., a homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 8%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from biocceleration(dot)com/Products(dot)html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 8%, 88%, 89%, 90%, 91%, 9%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from emboss(dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 8%, 88%, 89%, 90%, 91%, 9%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotidecomparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 8%, 88%, 89%, 90%, 91%, 9%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cutoff—60% Identity on a span of 60% of the sequences lengths because it is used only as a filter for the global alignment stage. In this specific embodiment (when the local identity is used), the default filtering of the Blast package is not utilized (by setting the parameter "-F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between Two Proteins (Following the Blastp Filter):

EMBOSS-6.0.1 Needleman-Wunsch algorithm with the following modified parameters: gapopen=8 gapextend=2. The rest of the parameters are unchanged from the default options listed here:

Standard (Mandatory) qualifiers:

[-asequence] sequence filename and optional format, or reference (input USA)

[-bsequence] seqall Sequence(s) filename and optional format, or reference (input USA)

-gapopen float [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0)

-gapextend float [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0)

[-outfile] align [*needle] Output alignment file name

Additional (Optional) Qualifiers:

-datafile matrixf [EBLOSUM62 for protein, EDNAFULL for DNA]. This is the scoring matrix file used when comparing sequences. By default, it is the file 'EBLOSUM62' (for proteins) or the file 'EDNAFULL' (for nucleic sequences). These files are found in the 'data' directory of the EMBOSS installation.

Advanced (Unprompted) Qualifiers:

| -[no]brief | boolean [Y] | Brief identity and similarity |

Associated Qualifiers:

| "-asequence" | associated | qualifiers |
|---|---|---|
| -sbegin1 | integer | Start of the sequence to be used |
| -send1 | integer | End of the sequence to be used |
| -sreverse1 | boolean | Reverse (if DNA) |
| -sask1 | boolean | Ask for begin/end/reverse |
| -snucleotide1 | boolean | Sequence is nucleotide |
| -sprotein1 | boolean | Sequence is protein |
| -slower1 | boolean | Make lower case |
| -supper1 | boolean | Make upper case |
| -sformat1 | string | Input sequence format |
| -sdbname1 | string | Database name |
| -sid1 | string | Entryname |

| -ufo1 | string | UFO features |
|---|---|---|
| -fformat1 | string | Features format |
| -fopenfile1 | string | Features file name |
| "-bsequence" | associated | qualifiers |
| -sbegin2 | integer | Start of each sequence to be used |
| -send2 | integer | End of each sequence to be used |
| -sreverse2 | boolean | Reverse (if DNA) |
| -sask2 | boolean | Ask for begin/end/reverse |
| -snucleotide2 | boolean | Sequence is nucleotide |
| -sprotein2 | boolean | Sequence is protein |
| -slower2 | boolean | Make lower case |
| -supper2 | boolean | Make upper case |
| -sformat2 | string | Input sequence format |
| -sdbname2 | string | Database name |
| -sid2 | string | Entryname |
| -ufo2 | string | UFO features |
| -fformat2 | string | Features format |
| -fopenfile2 | string | Features file name |
| "-outfile" | assoiciated | qualifiers |
| -aformat3 | string | Alignment format |
| -aextension3 | string | File name extension |
| -adirectory3 | string | Output directory |
| -aname3 | string | Base file name |
| -awidth3 | integer | Alignment width |
| -aaccshow3 | boolean | Show accession number in the header |
| -adesshow3 | boolean | Show description in the header |
| -ausashow3 | boolean | Show the full USA in the alignment |
| -aglobal3 | boolean | Show the full sequence in alignment |

General Qualifiers:

| -auto | boolean | Turn off prompts |
|---|---|---|
| -stdout | boolean | Write first file to standard output |
| -filter | boolean | Read first file from standard input, write first file to standard output |
| -options | boolean | Prompt for standard and additional values |
| -debug | boolean | Write debug output to program.dbg |
| -verbose | boolean | Report some/full command line options |
| -help | boolean | Report command line options. More information on associated and general qualifiers can be found with -help -verbose |
| -warning | boolean | Report warnings |
| -error | boolean | Report errors |
| -fatal | boolean | Report fatal errors |
| -die | boolean | Report dying program messages |

2. Between a Protein Sequence and a Nucleotide Sequence (Following the Tblastn Filter):

GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options:

Usage:

om -model=<model_fname>[-q=]query [-db=]database [options]

-model=<model_fname> Specifies the model that you want to run. All models supplied by Compugen are located in the directory $CGNROOT/models/.

Valid command line parameters:

-dev=<dev_name> Selects the device to be used by the application.

Valid devices are:

bic—Bioccelerator (valid for SW, XSW, FRAME_N2P, and FRAME_P2N models).

xlg—BioXL/G (valid for all models except XSW).

xlp—BioXL/P (valid for SW, FRAME+_N2P, and FRAME_P2N models).

xlh—BioXL/H (valid for SW, FRAME+_N2P, and FRAME_P2N models).

soft—Software device (for all models).

-q=<query> Defines the query set. The query can be a sequence file or a database reference. You can specify a query by its name or by accession number. The format is detected automatically. However, you may specify a format using the -qfint parameter. If you do not specify a query, the program prompts for one. If the query set is a database reference, an output file is produced for each sequence in the query.

-db=<database name> Chooses the database set. The database set can be a sequence file or a database reference. The database format is detected automatically. However, you may specify a format using -dfmt parameter.

-qacc Add this parameter to the command line if you specify query using accession numbers.

-dacc Add this parameter to the command line if you specify a database using accession numbers.

-dfmt/-qfint=<format_type> Chooses the database/query format type. Possible formats are:
   fasta—fasta with seq type auto-detected.
   fastap—fasta protein seq.
   fastan—fasta nucleic seq.
   gcg—gcg format, type is auto-detected.
   gcg9seq—gcg9 format, type is auto-detected.
   gcg9seqp—gcg9 format protein seq.
   gcg9seqn—gcg9 format nucleic seq.
   nbrf—nbrf seq, type is auto-detected.
   nbrfp—nbrf protein seq.
   nbrfn—nbrf nucleic seq.
   embl—embl and swissprot format.
   genbank—genbank format (nucleic).
   blast—blast format.
   nbrf_geg—nbrf-gcg seq, type is auto-detected.
   nbrf_gcgp—nbrf-gcg protein seq.
   nbrf_gcgn—nbrf-gcg nucleic seq.
   raw—raw ascii sequence, type is auto-detected.
   rawp—raw ascii protein sequence.
   rawn—raw ascii nucleic sequence.
   pir—pir codata format, type is auto-detected.
   profile—gcg profile (valid only for -qfint
   in SW, XSW, FRAME_P2N, and FRAME+_P2N).

-out=<out fname> The name of the output file.

-suffix=<name> The output file name suffix.

-gapop=<n> Gap open penalty. This parameter is not valid for FRAME+. For FrameSearch the default is 12.0. For other searches the default is 10.0.

-gapext=<n> Gap extend penalty. This parameter is not valid for FRAME+. For FrameSearch the default is 4.0. For other models: the default for protein searches is 0.05, and the default for nucleic searches is 1.0.

-qgapop=<n> The penalty for opening a gap in the query sequence. The default is 10.0. Valid for XSW.

-qgapext=<n> The penalty for extending a gap in the query sequence. The default is 0.05.
   Valid for XSW.

-start=<n> The position in the query sequence to begin the search.

-end=<n> The position in the query sequence to stop the search.

-qtrans Performs a translated search, relevant for a nucleic query against a protein database. The nucleic query is translated to six reading frames and a result is given for each frame.
   Valid for SW and XSW.

-dtrans Performs a translated search, relevant for a protein query against a DNA database. Each database entry is translated to six reading frames and a result is given for each frame.
   Valid for SW and XSW.
   Note: "-qtrans" and "-dtrans" options are mutually exclusive.

-matrix=<matrix_file> Specifies the comparison matrix to be used in the search. The matrix must be in the BLAST format. If the matrix file is not located in $CGNROOT/tables/matrix, specify the full path as the value of the -matrix parameter.

-trans=<transtab_name> Translation table. The default location for the table is $CGNROOT/tables/trans.

-onestrand Restricts the search to just the top strand of the query/database nucleic sequence.

-list=<n> The maximum size of the output hit list. The default is 50.

-docalign=<n> The number of documentation lines preceding each alignment. The default is 10.

-thr_score=<score_name> The score that places limits on the display of results. Scores that are smaller than -thr_min value or larger than -thr_max value are not shown. Valid options are:
   quality.
   zscore.
   escore.

-thr_max=<n> The score upper threshold. Results that are larger than -thr_max value are not shown.

-thr_min=<n> The score lower threshold. Results that are lower than -thr_min value are not shown.

-align=<n> The number of alignments reported in the output file.

-noalign Do not display alignment.
   Note: "-align" and "-noalign" parameters are mutually exclusive.

-outfmt=<format_name> Specifies the output format type. The default format is PFS. Possible values are:
   PFS—PFS text format
   FASTA—FASTA text format
   BLAST—BLAST text format -nonorm Do not perform score normalization.

-norm=<norm_name> Specifies the normalization method. Valid options are:
   log—logarithm normalization.
   std—standard normalization.
   stat—Pearson statistical method.
   Note: "-nonorm" and "-norm" parameters cannot be used together.
   Note: Parameters -xgapop, -xgapext, -fgapop, -fgapext, -ygapop, -ygapext, -delop, and -delext apply only to FRAME+.

-xgapop=<n> The penalty for opening a gap when inserting a codon (triplet). The default is 12.0.

-xgapext=<n> The penalty for extending a gap when inserting a codon (triplet). The default is 4.0.

-ygapop=<n> The penalty for opening a gap when deleting an amino acid. The default is 12.0.

-ygapext=<n> The penalty for extending a gap when deleting an amino acid. The default is 4.0.

-fgapop=<n> The penalty for opening a gap when inserting a DNA base. The default is 6.0.

-fgapext=<n> The penalty for extending a gap when inserting a DNA base. The default is 7.0.

-delop=<n> The penalty for opening a gap when deleting a DNA base. The default is 6.0.

-delext=<n> The penalty for extending a gap when deleting a DNA base. The default is 7.0.

-silent No screen output is produced.

-host=<host_name> The name of the host on which the server runs. By default, the application uses the host specified in the file $CGNROOT/cgnhosts.

-wait Do not go to the background when the device is busy. This option is not relevant for the Parseq or Soft pseudo device.

-batch Run the job in the background. When this option is specified, the file "$CGNROOT/defaults/batch.defaults" is used for choosing the batch command. If this file does not exist, the command "at now" is used to run the job.

Note: "-batch" and "-wait" parameters are mutually exclusive.

-version Prints the software version number.

-help Displays this help message. To get more specific help type:

"om -model=<model_fname>-help".

According to some embodiments the homology is a local homology or a local identity.

Local alignments tools include, but are not limited to the BlastP, BlastN, BlastX or TBLASTN software of the National Center of Biotechnology Information (NCBI), FASTA, and the Smith-Waterman algorithm.

A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.

Default parameters for blastp include: Max target sequences: 100; Expected threshold: e-5; Word size: 3; Max matches in a query range: 0; Scoring parameters: Matrix—BLOSUM62; filters and masking: Filter—low complexity regions.

Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

Modulating the expression and/or activity of the polypeptides of the present invention within a plant cell as to enhance the resistance of the plant to the pathogenic fungi may include enhancing the expression and/or activity of polypeptides identified to positively contribute to the plant defense mechanism against the pathogenic fungi or reducing the expression and/or activity of those polypeptides found to be associated with susceptibility to the fungus infection.

According to certain embodiments, enhancing the resistance of the plant or part thereof to the pathogenic fungus comprises enhancing the expression and/or activity of the at least one polypeptide compared to its expression and/or activity in the control plant.

According to certain aspects, the present invention provides a method for enhancing the resistance of a plant or a part thereof to at least one pathogenic fungus of the genus *Mycosphaerella* and fungi related thereto comprising expressing at least one exogenous polynucleotide encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polypeptide having an amino acid sequence selected from the group consisting of SEQ ID NOs:160-169, 171-187, 189-260 within at least one cell of the plant or part thereof, thereby enhancing the resistance of said plant or part thereof to the at least one pathogenic fungus compared to the resistance of a control plant. Each possibility represents a separate embodiment of the present invention.

According to certain aspects, the present invention provides a method for enhancing the resistance of a plant or a part thereof to at least one pathogenic fungus of the genus *Mycosphaerella* and fungi related thereto comprising expressing at least one exogenous polynucleotide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polynucleotide having an nucleic acid sequence selected from the group consisting of SEQ ID NOs:43-52, 54-70, 72-155 within at least one cell of the plant or part thereof, thereby enhancing the resistance of said plant or part thereof to the at least one pathogenic fungus and/or Oomycetes compared to the resistance of a corresponding control plant. Each possibility represents a separate embodiment of the present invention.

According to certain embodiments, enhancing the expression and/or activity of the polypeptide comprises introducing into at least one cell of the plant or part thereof an exogenous polynucleotide encoding said polypeptide, thereby producing a transgenic plant over-expressing said polypeptide compared to the control plant.

According to certain embodiments, the exogenous polynucleotide encodes a polypeptide endogenous to the at least one cell. According to other embodiments, the exogenous polynucleotide encodes a polypeptide heterologous to the at least one plant cell.

According to certain embodiments, the polynucleotide comprises a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a nucleic acid sequence selected from the group consisting of SEQ ID NOs:43-52, 54-70, 72-155. Each possibility represents a separate embodiment of the present invention.

According to certain embodiments, the polynucleotide is 80%-99% homologous to any one of the polynucleotides set forth in SEQ ID NOs:43-52, 54-70, 72-155. According to other embodiments, the polynucleotide is 85%-95% homologous to any one of the polynucleotides set forth in SEQ ID NOs:43-52, 54-70, 72-155. According to other embodiments, the polynucleotide is 90%-99% homologous to any one of the polynucleotides set forth in SEQ ID NOs:43-52, 54-70, 72-155.

According to other embodiments, the polynucleotide comprises the nucleic acid sequence set for the one any one of SEQ ID NOs:43-52, 54-70, 72-157. Each possibility represents a separate embodiment of the present invention. According to additional embodiments, the polynucleotide consists of the nucleic acid sequence set for the one any one of SEQ ID NOs:43-52, 54-70, 72-157. Each possibility represents a separate embodiment of the present invention.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure. For example, (see U.S. Pat. No. 7,214,862) the standard deviation of codon usage (SDCU), a measure of codon usage bias, may be calculated by first finding the squared proportional deviation of usage of each codon of the native gene relative to that of highly expressed plant genes, followed by a calculation of the average squared deviation. The formula used is:

$$SDCU = \sum_{n=1}^{N} [(X_n - Y_n)/Y_n]2/N$$

wherein Xn refers to the frequency of usage of codon n in highly expressed plant genes; Yn refers to the frequency of usage of codon n in the gene of interest; and N refers to the total number of codons in the gene of interest. A Table of codon usage from highly expressed genes of dicotyledonous plants is compiled using the data of Murray et al. (1989, Nuc Acids Res. 17:477-498).

Alternative method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (www.kazusa.or.jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is affected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively affect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application Publication No. WO 93/07278.

According to additional aspect, the present invention provides a nucleic acid construct comprising the isolated polynucleotide of the invention, further comprising at least one regulatory element for directing transcription of the nucleic acid sequence in a host plant cell.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of some embodiments of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

According to some embodiments of the invention, the isolated polynucleotide is heterologous to the plant cell (e.g., the polynucleotide is derived from a different plant species when compared to the plant cell, thus the isolated polynucleotide and the plant cell are not from the same plant species).

Any suitable promoter sequence can be used by the nucleic acid construct of the present invention. Preferably the promoter is selected from the group consisting of a constitutive promoter, a tissue-specific, or biotic-stress specific promoter, particularly promoters inducible by fungi infection.

According to some embodiments of the invention, the promoter is a plant promoter, which is suitable for expression of the exogenous polynucleotide in a plant cell.

Suitable promoters for expression in wheat include, but are not limited to, Wheat SPA promoter (SEQ ID NO:1; Albani et al, Plant Cell, 9: 171-184, 1997, which is fully incorporated herein by reference), wheat LMW (SEQ ID NO:2 (longer LMW promoter), and SEQ ID NO:3 (LMW promoter) and HMW glutenin-1 (SEQ ID NO:4 (Wheat HMW glutenin-1 longer promoter); and SEQ ID NO: 5 (WheatHMW glutenin-1 Promoter); Thomas and Flavell, The Plant Cell 2:1171-1180, 1990; Furtado et al., 2009 Plant Biotechnology Journal 7:240-253, each of which is fully incorporated herein by reference), wheat alpha, beta and gamma gliadins [e.g., SEQ ID NO:6 (wheat alpha gliadin, B genome, promoter); SEQ ID NO:7 (wheat gamma gliadin promoter); EMBO 3:1409-15, 1984, which is fully incorporated herein by reference], wheat TdPR60 [SEQ ID NO:8 (wheat TdPR60 longer promoter) or SEQ ID NO:9 (wheat TdPR60 promoter); Kovalchuk et al., Plant Mol Biol 71:81-98, 2009, which is fully incorporated herein by reference], maize Ub IPromoter [cultivar Nongda 105 (SEQ ID NO:10); GenBank: DQ141598.1; Taylor et al., Plant Cell Rep 1993 12: 491-495, which is fully incorporated herein by reference; and cultivar B73 (SEQ ID NO:11); Christensen, A H, et al. Plant Mol. Biol. 18 (4), 675-689 (1992), which is fully incorporated herein by reference]; rice actin 1 (SEQ ID NO:12; McElroy et al. 1990, The Plant Cell, Vol. 2, 163-171, which is fully incorporated herein by reference), rice GOS2 [SEQ ID NO: 13 (rice GOS2 longer promoter) and SEQ ID NO: 14 (rice GOS2 Promoter); De Pater et al. Plant J. 1992; 2: 837-44, which is fully incorporated herein by reference], arabidopsis Pho1 [SEQ ID NO: 15 (arabidopsis Pho1 Promoter); Hamburger et al., Plant Cell. 2002; 14: 889-902, which is fully incorporated herein by reference], ExpansinB promoters, e.g., rice ExpB5 [SEQ ID NO:16 (rice ExpB5 longer promoter) and SEQ ID NO:17 (rice ExpB5 promoter)] and Barley ExpB1 [SEQ ID NO:18 (barley ExpB1 Promoter), Won et al. Mol Cells. 2010; 30:369-76, which is fully incorporated herein by reference], barley SS2 (sucrose synthase 2) [(SEQ ID NO:19), Guerin and Carbonero, Plant Physiology May 1997 vol. 114 no. 1 55-62, which is fully incorporated herein by reference], and rice PG5a [SEQ ID NO:20, U.S. Pat. No. 7,700,835, Nakase et al., Plant Mol Biol. 32:621-30, 1996].

Suitable constitutive promoters include, for example, CaMV 35S promoter [SEQ ID NO:21 (CaMV 35S (pQXNc) Promoter); SEQ ID NO:22 (PJJ 35S from *Brachypodium*); SEQ ID NO:23 (CaMV 35S (OLD) Promoter) (Odell et al., Nature 313:810-812, 1985)], *Arabidopsis* At6669 promoter (SEQ ID NO:24 (*Arabidopsis* At6669 (OLD) Promoter); see PCT Publication No. WO04081173A2 or the new At6669 promoter (SEQ ID NO: 25 (*Arabidopsis* At6669 (NEW) Promoter)); maize Ub IPromoter [cultivar Nongda 105 (SEQ ID NO:10); and cultivar B73 (SEQ ID NO:11); rice actin 1 (SEQ ID NO:12); pEMU (Last et al., Theor. Appl. Genet. 81:581-588, 1991); CaMV 19S (Nilsson et al., Physiol. Plant 100:456-462, 1997); rice GOS2 [SEQ ID NO: 13 (rice GOS2 longer Promoter) and SEQ ID NO: 14 (rice GOS2 Promoter)]; RBCS promoter (SEQ ID NO:26); Rice cyclophilin (Bucholz et al, Plant Mol Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604,121; 5,569,597: 5,466,785; 5,399,680; 5,268,463; and 5,608,142.

Suitable tissue-specific promoters include, but not limited to, leaf-specific promoters [e.g., AT5G06690 (Thioredoxin) (high expression, SEQ ID NO: 27), AT5G61520 (AtSTP3) (low expression, SEQ ID NO: 28) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, Cell and Environment 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO:29 (*Brassica napus* NAPIN Promoter) from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (SEQ ID NO: 20), early seed development *Arabidopsis* BAN (AT1G61720) (SEQ ID NO:30, US 2009/0031450 A1), late seed development *Arabidopsis* ABI3 (AT3G24650) (SEQ ID NO:31 (*Arabidopsis* ABI3 (AT3G24650) longer Promoter) or SEQ ID NO:32 (*Arabidopsis* ABI3 (AT3G24650) Promoter)) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143). 323-32 1990), napA (Stalberg, et al, Planta 199: 515-519, 1996), Wheat SPA (SEQ ID NO:1; Albani et al, Plant Cell, 9: 171-184, 1997), sunflower oleosin (Cummins, et al., Plant Mol. Biol. 19: 873-876, 1992)], endosperm specific promoters [e.g., wheat LMW (SEQ ID NO: 2 (Wheat LMW Longer Promoter), and SEQ ID NO:3 (Wheat LMW Promoter) and HMW glutenin-1 [(SEQ ID NO:4 (Wheat HMW glutenin-1 longer Promoter)); and SEQ ID NO:5 (Wheat HMW glutenin-1 Promoter), Thomas and Flavell, The Plant Cell 2:1171-1180, 1990; Mol Gen Genet 216:81-90, 1989; NAR 17:461-2), wheat alpha, beta and gamma gliadins (SEQ ID NO:6 (wheat alpha gliadin (B genome) promoter); SEQ ID NO:7

(wheat gamma gliadin promoter); Barley ltr1 promoter, barley B1, C, D hordein (Theor Appl Gen 98:1253-62, 1999; Plant J 4:343-55, 1993; Mol Gen Genet 250:750-60, 1996), Barley DOF (Mena et al, The Plant Journal, 116(1): 53-62, 1998), Biz2 (EP99106056.7), Barley SS2 (SEQ ID NO:19 (Barley SS2 Promoter); wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice -globulin Glb-1 (Wu et al, Plant Cell Physiology 39(8) 885-889, 1998), rice alpha-globulin REB/ OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen Genet. 217:240-245; 1989), *Arabidopsis apetala*-3 (Tilly et al., Development. 125:1647-57, 1998), *Arabidopsis* APETALA 1 (AT1G69120, API) (SEQ ID NO:33 (*Arabidopsis* (AT1G69120) APETALA 1)) (Hempel et al., Development 124:3845-3853, 1997)], and root promoters [e.g., the ROOTP promoter [SEQ ID NO:34]; rice ExpB5 [SEQ ID NO:17 (rice ExpB5 Promoter); or SEQ ID NO:16 (rice ExpB5 longer Promoter)] and barley ExpB1 promoters (SEQ ID NO:18); *Arabidopsis* ATTPS-CIN (AT3G25820) promoter (SEQ ID NO:35; Chen et al., Plant Phys 135:1956-66, 2004); arabidopsis Pho1 promoter (SEQ ID NO:15, which is also slightly induced by stress.

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced from the seedlings to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plant is generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is a virulent and thus is incapable of causing severe symptoms such as reduced growth rate, mosaic, ring spots, leaf roll, yellowing, streaking, pox formation, tumor formation and pitting. A suitable a virulent virus may be a naturally occurring a virulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Taylor, Eds. "Plant Virology Protocols: From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

According to some embodiments of the invention, the transformed plant is homozygote to the transgene (i.e., the exogenous polynucleotide of some embodiments of the invention), and accordingly all seeds generated thereby include the transgene.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, early flowering, grain filling period, harvest index, plant height, growth, biomass, yield and/or vigor traits, using conventional plant breeding techniques.

According to certain embodiments, enhancing the resistance of the plant or part thereof to the pathogenic fungus comprises reducing the expression and/or activity of the at least one polypeptide compared to its expression and/or activity in the control plant.

Any method as is known in the art for reducing the expression and/or activity of a plant endogenous protein and the polynucleotide encoding same can be used according to the teachings of the resent invention.

According to certain embodiment of the invention, reducing the expression and/or activity of a polypeptide of the invention within a plant cell comprising transforming the plant cell with a polynucleotide that inhibits the expression of said polypeptide. The polynucleotide may inhibit the transcription or translation of a polynucleotide encoding said polypeptide or can encode for an inhibitory polypeptide interfering with the translation or activity of said polypeptide.

Polynucleotide-Based Methods

According to some embodiments of the present disclosure, a plant is transformed with a polynucleotide that inhibits the expression of a polypeptide of the invention. According to certain exemplary embodiments, the plant cell is transformed within a construct capable of expressing the inhibitory polynucleotide. The term "expression" as used herein refers to the biosynthesis of a gene product, including the transcription and/or translation of said gene product. For example, for the purposes of the present invention, a construct capable of expressing the inhibitory polynucleotide is capable of producing an RNA molecule that inhibits the transcription and/or translation of a polypeptide of the invention. The "expression" or "production" of a protein or polypeptide from a DNA molecule refers to the transcription and translation of the coding sequence to produce the protein or polypeptide, while the "expression" or "production" of a protein or polypeptide from an RNA molecule refers to the translation of the RNA coding sequence to produce the protein or polypeptide. Examples of polynucleotides that inhibit the expression of a CCT polypeptide are given below.

Sense Suppression/Co-Suppression

According to certain embodiments, inhibition of the expression of a polypeptide of the invention may be obtained by sense suppression or co-suppression. For co-suppression, a construct is designed to express an RNA molecule corresponding to all or part of a messenger RNA encoding the polypeptide in the "sense" orientation. Over-expression of the RNA molecule can result in reduced expression of the native gene. Accordingly, multiple plant lines transformed with the co-suppression constructs are screened to identify those that show the greatest inhibition of the polypeptide expression.

The polynucleotide used for co-suppression may correspond to all or part of the sequence encoding the polypeptide of the invention, all or part of the 5' and/or 3' untranslated region of said polypeptide transcript or all or part of both the coding sequence and the untranslated regions of a transcript encoding said polypeptide. In some embodiments where the polynucleotide comprises all or part of the coding region for said polypeptide, the construct is designed to eliminate the start codon of the polynucleotide so that no protein product will be translated.

Co-suppression may be used to inhibit the expression of plant genes to produce plants having undetectable protein levels for the proteins encoded by these genes. See, for example, Broin, et al., (2002) Plant Cell 14:1417-1432. Co-suppression may also be used to inhibit the expression of multiple proteins in the same plant. See, for example, U.S. Pat. No. 5,942,657. Methods for using co-suppression to inhibit the expression of endogenous genes in plants are described, for example, in Yu, et al., Phytochemistry (2003) 63:753-763 and U.S. Pat. Nos. 5,034,323, 5,283,184 and 5,942,657. The efficiency of co-suppression may be increased by including a poly-dT region in the expression cassette at a position 3' to the sense sequence and 5' of the polyadenylation signal. See for example, US Patent Application Publication Number 2002/0048814. Typically, such a nucleotide sequence has substantial sequence identity to the sequence of the transcript of the endogenous gene, optimally greater than about 65% sequence identity, more optimally greater than about 85% sequence identity, most optimally greater than about 95% sequence identity (U.S. Pat. Nos. 5,283,184 and 5,034,323).

Antisense Suppression

According to some embodiments, inhibition of the expression of a polypeptide of the invention may be obtained by antisense suppression. For antisense suppression, the construct is designed to express an RNA molecule complementary to all or part of a messenger RNA encoding the polypeptide. Over-expression of the antisense RNA molecule can result in reduced expression of the native gene. Accordingly, multiple plant lines transformed with the antisense RNA are screened to identify those that show the greatest inhibition of said polypeptide expression.

The polynucleotide for use in antisense suppression may correspond to all or part of the complement of the sequence encoding the polypeptide of the invention, all or part of the complement of the 5' and/or 3' untranslated region of its transcript or all or part of the complement of both the coding sequence and the untranslated regions of a transcript encoding said polypeptide. In addition, the antisense polynucleotide may be fully complementary (i.e., 100% identical to the complement of the target sequence) or partially complementary (i.e., less than 100% identical to the complement of the target sequence) to the target sequence. Antisense suppression may be used to inhibit the expression of multiple proteins in the same plant. See, for example, U.S. Pat. No. 5,942,657. Furthermore, portions of the antisense nucleotides may be used to disrupt the expression of the target gene. Generally, sequences of at least 50 nucleotides, 100 nucleotides, 200 nucleotides, 300, 400, 450, 500, 550 or greater may be used. Methods for using antisense suppression to inhibit the expression of endogenous genes in plants are described, for example, in Liu, et al., (2002) Plant Physiol. 129:1732-1743 and U.S. Pat. Nos. 5,759,829 and 5,942,657. Efficiency of antisense suppression may be increased by including a poly-dT region in the expression cassette at a position 3' to the antisense sequence and 5' of the polyadenylation signal (see, e.g. US Patent Application Publication Number 2002/0048814).

Double-Stranded RNA Interference

According to some embodiments, inhibition of the expression of a polypeptide of the invention may be obtained by double-stranded RNA (dsRNA) interference. For dsRNA interference, a sense RNA molecule like that described above for co-suppression and an antisense RNA molecule that is fully or partially complementary to the sense RNA molecule are expressed in the same cell, resulting in inhibition of the expression of the corresponding endogenous messenger RNA.

Expression of the sense and antisense molecules can be accomplished by designing the DNA construct to comprise both a sense sequence and an antisense sequence. Alternatively, separate constructs may be used for the sense and antisense sequences. Multiple plant lines transformed with the dsRNA interference construct(s) are then screened to identify plant lines that show the greatest inhibition of the expression of the polypeptide. Methods for using dsRNA interference to inhibit the expression of endogenous plant genes are described in Waterhouse, et al., (1998) Proc. Natl. Acad. Sci. USA 95:13959-13964, Liu, et al., (2002) Plant Physiol. 129:1732-1743 and WO 1999/49029, WO 1999/53050, WO 1999/61631 and WO 2000/49035.

Hairpin RNA Interference and Intron-Containing Hairpin RNA Interference

According to some embodiments, inhibition of the expression of a polypeptide of the invention may be obtained by hairpin RNA (hpRNA) interference or intron-containing hairpin RNA (ihpRNA) interference. These methods are highly efficient at inhibiting the expression of endogenous genes. See, Waterhouse and Helliwell, (2003) Nat. Rev. Genet. 4:29-38 and the references cited therein.

For hpRNA interference, the construct is designed to express an RNA molecule that hybridizes with itself to form a hairpin structure that comprises a single-stranded loop region and a base-paired stem. The base-paired stem region comprises a sense sequence corresponding to all or part of the endogenous messenger RNA encoding the gene whose expression is to be inhibited and an antisense sequence that is fully or partially complementary to the sense sequence. Thus, the base-paired stem region of the molecule generally determines the specificity of the RNA interference. hpRNA molecules are highly efficient at inhibiting the expression of endogenous genes, and the RNA interference they induce is inherited by subsequent generations of plants. See, for example, Chuang and Meyerowitz, (2000) Proc. Natl. Acad. Sci. USA 97:4985-4990; Stoutjesdijk, et al., (2002) Plant Physiol. 129:1723-1731 and Waterhouse and Helliwell, (2003) Nat. Rev. Genet. 4:29-38. Methods for using hpRNA interference to inhibit or silence the expression of genes are described, for example, in US Patent Application Publication Number 2003/0175965. A transient assay for the efficiency of hpRNA constructs to silence gene expression in vivo has been described by Panstruga, et al., (2003) Mol. Biol. Rep. 30:135-140.

For Intron-Containing Hairpin RNA (ihpRNA) interference, the interfering molecules have the same general structure as for hpRNA, but the RNA molecule additionally comprises an intron that is capable of being spliced in the cell in which the ihpRNA is expressed. The use of an intron minimizes the size of the loop in the hairpin RNA molecule following splicing, and this increases the efficiency of interference. See, for example, Smith, et al., (2000) Nature 407:319-320. In fact, Smith, et al., shows 100% suppression of endogenous gene expression using ihpRNA-mediated interference. Methods for using ihpRNA interference to inhibit the expression of endogenous plant genes are described, for example, in US Patent Application Publication Number 2003/0180945.

The expression cassette for hpRNA interference may also be designed such that the sense sequence and the antisense sequence do not correspond to an endogenous RNA. In this embodiment, the sense and antisense sequence flank a loop sequence that comprises a nucleotide sequence corresponding to all or part of the endogenous messenger RNA of the target gene. Thus, it is the loop region that determines the specificity of the RNA interference. See, for example, WO 2002/00904.

Amplicon-Mediated Interference

Amplicon expression cassettes comprise a plant virus-derived sequence that contains all or part of the target gene but generally not all of the genes of the native virus. The viral sequences present in the transcription product of the construct allow the transcription product to direct its own replication. The transcripts produced by the amplicon may be either sense or antisense relative to the target sequence (i.e., the messenger RNA for the polypeptide of the invention). Methods of using amplicons to inhibit the expression of endogenous plant genes are described, for example, in Angell and Baulcombe, (1997) EMBO J. 16:3675-3684, Angell and Baulcombe, (1999) Plant J. 20:357-362.

Ribozymes

According to some embodiments, the polynucleotide expressed by the construct of the invention is catalytic RNA or has ribozyme activity specific for the messenger RNA of a polypeptide of the invention. Thus, the polynucleotide causes the degradation of the endogenous messenger RNA, resulting in reduced expression of said polypeptide. This method is described, for example, in U.S. Pat. No. 4,987,071.

Small Interfering RNA or Micro RNA

According to certain embodiments of the invention, inhibition of the expression of a polypeptide of the invention may be obtained by RNA interference by expression of a gene encoding a micro RNA (miRNA). miRNAs are regulatory agents consisting of about 22 ribonucleotides. miRNAs are highly efficient at inhibiting the expression of endogenous genes. See, for example, Palatnikl J F et al., (2003) Nature 425:257-263.

For miRNA interference, the construct is designed to express an RNA molecule that is modeled on an endogenous miRNA gene. The miRNA gene encodes an RNA that forms a hairpin structure containing a 22-nucleotide sequence that is complementary to another endogenous gene (target sequence). For suppressing the expression of a polypeptide of the invention, the 22-nucleotide sequence is selected from the polypeptide transcript sequence and contains 22 nucleotides of said transcript sequence in sense orientation and 21 nucleotides of a corresponding antisense sequence that is complementary to the sense sequence. miRNA molecules are highly efficient at inhibiting the expression of endogenous genes and the RNA interference they induce is inherited by subsequent generations of plants.

Polypeptide-Based Inhibition of Gene Expression

According to certain additional or alternative embodiments, the inhibitory polynucleotide encodes a zinc finger protein that binds to a gene encoding a polypeptide of the invention, resulting in reduced expression of the gene. In particular embodiments, the zinc finger protein binds to a regulatory region of a polypeptide encoding gene. In other embodiments, the zinc finger protein binds to a messenger RNA encoding said polypeptide and prevents its translation. Methods of selecting sites for targeting by zinc finger proteins have been described, for example, in U.S. Pat. No. 6,453,242 and methods for using zinc finger proteins to inhibit the expression of genes in plants are described, for example, in U.S. Pat. No. 7,151,201.

Polypeptide-Based Inhibition of Protein Activity

According to certain additional or alternative embodiments, the polynucleotide encodes an antibody that binds to a polypeptide of the invention and reduces the activity of the polypeptide. In another embodiment, the binding of the antibody results in increased turnover of the antibody-polypeptide complex by cellular quality control mechanisms. The expression of antibodies in plant cells and the inhibition of molecular pathways by expression and binding of antibodies to proteins in plant cells are well known in the art. See, for example, Conrad and Sonnewald, (2003) Nature Biotech. 21:35-36.

According to some embodiments of the invention, up-regulation or down-regulation of the expression of a polypeptide of the invention is achieved by means of genome editing.

Genome editing is a reverse genetics method which uses artificially engineered nucleases to cut and create specific double-stranded breaks at a desired location(s) in the genome, which are then repaired by cellular endogenous processes such as, homology directed repair (HDR) and non-homologous end-joining (NHEJ). NHEJ directly joins the DNA ends in a double-stranded break, while HDR utilizes a homologous sequence as a template for regenerating the missing DNA sequence at the break point. In order to introduce specific nucleotide modifications to the genomic DNA, a DNA repair template containing the desired sequence must be present during HDR. Genome editing cannot be performed using traditional restriction endonucleases since most restriction enzymes recognize a few base pairs on the DNA as their target and the probability is very high that the recognized base pair combination will be found in many locations across the genome resulting in multiple cuts not limited to a desired location. To overcome this challenge and create site-specific single- or double-stranded breaks, several distinct classes of nucleases have been discovered and bioengineered to date. These include the meganucleases, Zinc finger nucleases (ZFNs), transcription-activator like effector nucleases (TALENs) and CRISPR/Cas system.

Genome editing is a powerful tool to impact target traits by modifications of the target plant genome sequence. Such modifications can result in new or modified alleles or regulatory elements.

In addition, the traces of genome-edited techniques can be used for marker assisted selection (MAS) as is further described hereinunder. Target plants for the mutagenesis/ genome editing methods according to the invention are any plants of interest including monocot or dicot plants.

Over-expression of a polypeptide by genome editing can be achieved by: (i) replacing an endogenous sequence encoding the polypeptide of interest or a regulatory sequence under which it is placed, and/or (ii) inserting a new gene encoding the polypeptide of interest in a targeted region of the genome, and/or (iii) introducing point mutations which result in up-regulation of the gene encoding the polypeptide of interest (e.g., by altering the regulatory sequences such as promoter, enhancers, 5'-UTR and/or 3'-UTR, or mutations in the coding sequence).

Down regulation of the expression of a polypeptide by genome editing can be achieved by (i) replacing an endogenous sequence encoding a polypeptide negatively affecting a desired plant trait, according to some embodiments of the invention enhancing susceptibility of the plant to pathogenic fungi or replacing a regulatory sequence under which the endogenous sequence encoding the polypeptide is placed, and/or (ii) introducing point mutations which result in down-regulation of the gene encoding the polypeptide of interest (e.g., by altering the regulatory sequences such as promoter, enhancers, 5'-UTR and/or 3'-UTR, or mutations in the coding sequence). As described hereinabove, the term "down regulation" encompasses inhibition of a gene function (gene knockdown) and complete elimination of gene function (gene knockout).

Genome Editing Systems Overview

Several systems have been reported to enable genome editing implementation. Examples detailed herein below:

Meganucleases—Meganucleases are commonly grouped into four families: the LAGLIDADG family, the GIY-YIG family, the His-Cys box family and the HNH family. These families are characterized by structural motifs, which affect catalytic activity and recognition sequence. For instance, members of the LAGLIDADG family are characterized by having either one or two copies of the conserved LAGLIDADG motif. The four families of meganucleases are widely separated from one another with respect to conserved structural elements and, consequently, DNA recognition sequence specificity and catalytic activity. Meganucleases are found commonly in microbial species and have the unique property of having very long recognition sequences (>14 bp) thus making them naturally very specific for cutting at a desired location. This can be exploited to make site-specific double-stranded breaks directing modifications in regulatory elements or coding regions upon introduction of the desired sequence. One of skill in the art can use these naturally occurring meganucleases, however the number of such naturally occurring meganucleases is limited. To overcome this challenge, mutagenesis and high throughput screening methods have been used to create meganuclease variants that recognize unique sequences. For example, various meganucleases have been fused to create hybrid enzymes that recognize a new sequence. Alternatively, DNA interacting amino acids of the meganuclease can be altered to design sequence specific meganucleases (see e.g., U.S. Pat. No. 8,021,867). Meganucleases can be designed using the methods described in e.g., Certo, M T et al. Nature Methods (2012) 9:073-975; U.S. Pat. Nos. 8,304,222; 8,021,867; 8,119,381; 8,124,369; 8,129,134; 8,133,697; 8,143,015; 8,143,016; 8,148,098; or 8,163,514, the contents of each are incorporated herein by reference in their entirety. Alternatively, meganucleases with site specific cutting characteristics can be obtained using commercially available technologies e.g., Precision Biosciences' Directed Nuclease Editor™ genome editing technology.

ZFNs and TALENs—Two distinct classes of engineered nucleases, zinc-finger nucleases (ZFNs) and transcription activator-like effector nucleases (TALENs), have both proven to be effective at producing targeted double-stranded breaks (Christian et al., (2010), Genetics 186:757-761; Kim et al., (1996), Proc. Natl. Acad. Sci. 93:1156-1160; Li et al., (2011), Nucleic Acids Res 39:359-372; Mahfouz et al., (2011), Proc. Natl. Acad. Sci; 108:2623-2628 Miller et al., (2010), Nat Biotechnol. 29:143-148

Basically, ZFNs and TALENs restriction endonuclease technology utilizes a non-specific DNA cutting enzyme which is linked to a specific DNA binding domain (either a series of zinc finger domains or TALE repeats, respectively). Typically, a restriction enzyme whose DNA recognition site and cleaving site are separate from each other is selected. The cleaving portion is separated and then linked to a DNA binding domain, thereby yielding an endonuclease with very high specificity for a desired sequence. An exemplary restriction enzyme with such properties is FokI. Additionally, FokI has the advantage of requiring dimerization to have nuclease activity and this means the specificity increases dramatically as each nuclease partner recognizes a unique DNA sequence. To enhance this effect, FokI nucleases have been engineered that can only function as heterodimers and have increased catalytic activity. The heterodimer functioning nucleases avoid the possibility of unwanted homodimer activity and thus increase specificity of the double-stranded break.

Thus, for example to target a specific site, ZFNs and TALENs are constructed as nuclease pairs, with each member of the pair designed to bind adjacent sequences at the targeted site. Upon transient expression in cells, the nucleases bind to their target sites and the FokI domains heterodimerize to create a double-stranded break. Repair of these double-stranded breaks through the nonhomologous end-joining (NHEJ) pathway most often results in small deletions or small sequence insertions. Since each repair made by NHEJ is unique, the use of a single nuclease pair can produce an allelic series with a range of different deletions at the target site. The deletions typically range anywhere from a few base pairs to a few hundred base pairs in length, but larger deletions have successfully been generated in cell culture by using two pairs of nucleases simultaneously (Carlson et al., (2012), Proc. Natl. Acad. Sci; 109:17382-17387; Lee et al., (2010) Genome Res 20:81-89). In addition, when a fragment of DNA with homology to the targeted region is introduced in conjunction with the nuclease pair, the double-stranded break can be repaired via homology directed repair to generate specific modifications (Li et al., (2011), Nucleic Acids Res 39:359-372; Miller et al., (2010), Nat Biotechnol. 29:143-148; Urnov et al., (2005), Nature, 435:646-651.

Although the nuclease portions of both ZFNs and TALENs have similar properties, the difference between these engineered nucleases is in their DNA recognition peptide. ZFNs rely on Cys2-His2 zinc fingers and TALENs on TALEs. Both of these DNA recognizing peptide domains have the characteristic that they are naturally found in combinations in their proteins. Cys2-His2 Zinc fingers typically found in repeats that are 3 bp apart and are found in diverse combinations in a variety of nucleic acid interacting proteins. TALEs on the other hand are found in repeats with a one-to-one recognition ratio between the amino acids and the recognized nucleotide pairs. Because both zinc fingers and TALEs happen in repeated patterns, different combinations can be tried to create a wide variety of sequence specificities. Approaches for making site-specific zinc finger endonucleases include, e.g., modular assembly (where Zinc fingers correlated with a triplet sequence are attached in a row to cover the required sequence), OPEN (low-stringency selection of peptide domains vs. triplet nucleotides followed by high-stringency selections of peptide combination vs. the final target in bacterial systems), and bacterial one-hybrid screening of zinc finger libraries, among others. ZFNs can also be designed and obtained commercially from e.g., Sangamo Biosciences™ (Richmond, Calif.).

Method for designing and obtaining TALENs are described in e.g. Reyon et al. Nature Biotechnology (2012) 30(5): 460-5; Miller et al. Nat Biotechnol. (2011) 29: 143-148; Cermak et al. Nucleic Acids Research (2011) 39 (12): e82 and Zhang et al. Nature Biotechnology (2011) 29 (2): 149-53. A recently developed web-based program named Mojo Hand was introduced by Mayo Clinic for designing TAL and TALEN constructs for genome editing applications (can be accessed through www(dot)talendesign (dot)org). TALEN can also be designed and obtained commercially from e.g., Sangamo Biosciences™ (Richmond, Calif.).

The ZFN/TALEN system capability for precise targeting can be utilized for directing modifications in regulatory elements and/or coding regions upon introduction of the sequence of interest for trait improvement.

CRISPR/Cas9—The CRIPSR/Cas system for genome editing contains two distinct components: a gRNA (guide RNA) and an endonuclease e.g. Cas9.

The gRNA is typically a 20-nucleotide sequence encoding a combination of the target homologous sequence (crRNA) and the endogenous bacterial RNA that links the crRNA to the Cas9 nuclease (tracrRNA) in a single chimeric transcript. The gRNA/Cas9 complex is recruited to the target sequence by the base-pairing between the gRNA sequence and the complement genomic DNA. For successful binding of Cas9, the genomic target sequence must also contain the correct Protospacer Adjacent Motif (PAM) sequence immediately following the target sequence. The binding of the gRNA/Cas9 complex localizes the Cas9 to the genomic target sequence so that the Cas9 can cut both strands of the DNA causing a double-strand break. Just as with ZFNs and TALENs, the double-stranded brakes produced by CRISPR/Cas can undergo homologous recombination or NHEJ.

The Cas9 nuclease has two functional domains: RuvC and HNH, each cutting a different DNA strand. When both of these domains are active, the Cas9 causes double strand breaks in the genomic DNA.

A significant advantage of CRISPR/Cas is that the high efficiency of this system coupled with the ability to easily create synthetic gRNAs enables multiple genes to be targeted simultaneously. In addition, the majority of cells carrying the mutation present biallelic mutations in the targeted genes.

However, apparent flexibility in the base-pairing interactions between the gRNA sequence and the genomic DNA target sequence allows imperfect matches to the target sequence to be cut by Cas9.

Modified versions of the Cas9 enzyme containing a single inactive catalytic domain, either RuvC- or HNH-, are called 'nickases'. With only one active nuclease domain, the Cas9 nickase cuts only one strand of the target DNA, creating a single-strand break or 'nick'. A single-strand break, or nick, is normally quickly repaired through the HDR pathway, using the intact complementary DNA strand as the template. However, two proximal, opposite strand nicks introduced by a Cas9 nickase are treated as a double-strand break, in what is often referred to as a 'double nick' CRISPR system. A double-nick can be repaired by either NHEJ or HDR depending on the desired effect on the gene target. Thus, if specificity and reduced off-target effects are crucial, using the Cas9 nickase to create a double-nick by designing two gRNAs with target sequences in close proximity and on opposite strands of the genomic DNA would decrease off-target effect as either gRNA alone will result in nicks that will not change the genomic DNA.

Modified versions of the Cas9 enzyme containing two inactive catalytic domains (dead Cas9, or dCas9) have no nuclease activity while still able to bind to DNA based on gRNA specificity. The dCas9 can be utilized as a platform for DNA transcriptional regulators to activate or repress gene expression by fusing the inactive enzyme to known regulatory domains. For example, the binding of dCas9 alone to a target sequence in genomic DNA can interfere with gene transcription.

There are a number of publicly available tools available to help choose and/or design target sequences as well as lists of bioinformatically determined unique gRNAs for different genes in different species such as the Feng Zhang lab's Target Finder, the Michael Boutros lab's Target Finder (E-CRISP), the RGEN Tools: Cas-OFFinder, the CasFinder: Flexible algorithm for identifying specific Cas9 targets in genomes and the CRISPR Optimal Target Finder.

In order to use the CRISPR system, both gRNA and Cas9 should be expressed in a target cell. The insertion vector can contain both cassettes on a single plasmid or the cassettes are expressed from two separate plasmids. CRISPR plasmids are commercially available such as the px330 plasmid from Addgene.

Recombinant adeno-associated virus (rAAV) platform—this genome-editing platform is based on rAAV vectors which enable insertion, deletion or substitution of DNA sequences in the genomes of live mammalian cells. The rAAV genome is a single-stranded deoxyribonucleic acid (ssDNA) molecule, either positive- or negative-sensed, which is about 4.7 kb long. These single-stranded DNA viral vectors have high transduction rates and have a unique property of stimulating endogenous homologous recombination in the absence of double-strand DNA breaks in the genome. One of skill in the art can design a rAAV vector to target a desired genomic locus and perform both gross and/or subtle endogenous gene alterations in a cell. rAAV genome editing has the advantage in that it targets a single allele and does not result in any off-target genomic alterations. rAAV genome editing technology is commercially available, for example, the rAAV GENESIS™ system from Horizon™ (Cambridge, UK).

Methods for qualifying efficacy and detecting sequence alteration are well known in the art and include, but not limited to, DNA sequencing, electrophoresis, an enzyme-based mismatch detection assay and a hybridization assay such as PCR, RT-PCR, RNase protection, in-situ hybridization, primer extension, Southern blot, Northern Blot and dot blot analysis.

Sequence alterations in a specific gene can also be determined at the protein level using e.g. chromatography, electrophoretic methods, immunodetection assays such as ELISA and Western blot analysis and immunohistochemistry.

In addition, one ordinarily skilled in the art can readily design a knock-in/knock-out construct including positive and/or negative selection markers for efficiently selecting transformed cells that underwent a homologous recombination event with the construct. Positive selection provides a means to enrich the population of clones that have taken up foreign DNA. Non-limiting examples of such positive markers include glutamine synthetase, dihydrofolate reductase (DHFR), markers that confer antibiotic resistance, such as neomycin, hygromycin, puromycin, and blasticidin S resistance cassettes. Negative selection markers are necessary to select against random integrations and/or elimination of a marker sequence (e.g. positive marker). Non-limiting examples of such negative markers include the herpes simplex-thymidine kinase (HSV-TK) which converts ganciclovir (GCV) into a cytotoxic nucleoside analog, hypoxanthine phosphoribosyltransferase (HPRT) and adenine phosphoribosytransferase (ARPT).

Recombination Procedures—Common to Different Genome Editing Systems

Hit and run" or "in-out"—involves a two-step recombination procedure. In the first step, an insertion-type vector containing a dual positive/negative selectable marker cassette is used to introduce the desired sequence alteration. The insertion vector contains a single continuous region of homology to the targeted locus and is modified to carry the mutation of interest. This targeting construct is linearized with a restriction enzyme at a one site within the region of homology, electroporated into the cells, and positive selection is performed to isolate homologous recombinants. These homologous recombinants contain a local duplication that is separated by intervening vector sequence, including the selection cassette. In the second step, targeted clones are subjected to negative selection to identify cells that have lost the selection cassette via intrachromosomal recombination between the duplicated sequences. The local recombination event removes the duplication and, depending on the site of recombination, the allele either retains the introduced mutation or reverts to wild type. The end result is the introduction of the desired modification without the retention of any exogenous sequences.

The "double-replacement" or "tag and exchange" strategy—involves a two-step selection procedure similar to the hit and run approach, but requires the use of two different targeting constructs. In the first step, a standard targeting vector with 3' and 5' homology arms is used to insert a dual positive/negative selectable cassette near the location where the mutation is to be introduced. After electroporation and positive selection, homologously targeted clones are identified. Next, a second targeting vector that contains a region of homology with the desired mutation is electroporated into targeted clones, and negative selection is applied to remove the selection cassette and introduce the mutation. The final allele contains the desired mutation while eliminating unwanted exogenous sequences.

Site-Specific Recombinases—The Cre recombinase derived from the P1 bacteriophage and Flp recombinase derived from the yeast *Saccharomyces cerevisiae* are site-specific DNA recombinases each recognizing a unique 34 base pair DNA sequence (termed "Lox" and "FRT", respectively) and sequences that are flanked with either Lox sites or FRT sites can be readily removed via site-specific recombination upon expression of Cre or Flp recombinase, respectively. For example, the Lox sequence is composed of an asymmetric eight base pair spacer region flanked by 13 base pair inverted repeats. Cre recombines the 34 base pair lox DNA sequence by binding to the 13 base pair inverted repeats and catalyzing strand cleavage and re-ligation within the spacer region. The staggered DNA cuts made by Cre in the spacer region are separated by 6 base pairs to give an overlap region that acts as a homology sensor to ensure that only recombination sites having the same overlap region recombine. Basically, the site-specific recombinase system offers means for the removal of selection cassettes after homologous recombination. This system also allows for the generation of conditional altered alleles that can be inactivated or activated in a temporal or tissue-specific manner. Of note, the Cre and Flp recombinases leave behind a Lox or FRT "scar" of 34 base pairs. The Lox or FRT sites that remain are typically left behind in an intron or 3' UTR of the modified locus, and current evidence suggests that these sites usually do not interfere significantly with gene function. Thus, Cre/Lox and Flp/FRT recombination involves introduction of a targeting vector with 3' and 5' homology arms containing the mutation of interest, two Lox or FRT sequences and typically a selectable cassette placed between the two Lox or FRT sequences. Positive selection is applied and homologous recombinants that contain targeted mutation are identified. Transient expression of Cre or Flp in conjunction with negative selection results in the excision of the selection cassette and selects for cells where the cassette has been lost. The final targeted allele contains the Lox or FRT scar of exogenous sequences.

Transposases—As used herein, the term "transposase" refers to an enzyme that binds to the ends of a transposon and catalyzes the movement of the transposon to another part of the genome.

As used herein the term "transposon" refers to a mobile genetic element comprising a nucleotide sequence which can move around to different positions within the genome of a single cell. In the process the transposon can cause mutations and/or change the amount of a DNA in the genome of the cell. A number of transposon systems that are able to also transpose in cells e.g. vertebrates have been isolated or designed, such as Sleeping Beauty [Izsvák and Ivics Molecular Therapy (2004) 9: 147-156], piggyBac [Wilson et al. Molecular Therapy (2007) 15: 139-145], Tol2 [Kawakami et al. PNAS (2000) 97 (21): 11403-11408] or Frog Prince [Miskey et al. Nucleic Acids Res. Dec. 1, (2003) 31(23): 6873-6881]. Generally, DNA transposons translocate from one DNA site to another in a simple, cut-and-paste manner. Each of these elements has their own advantages, for example, Sleeping Beauty is particularly useful in region-specific mutagenesis, whereas Tol2 has the highest tendency to integrate into expressed genes. Hyperactive systems are available for Sleeping Beauty and piggyBac. Most importantly, these transposons have distinct target site preferences, and can therefore introduce sequence alterations in overlapping, but distinct sets of genes. Therefore, to achieve the best possible coverage of genes, the use of more than one element is particularly preferred. The basic mechanism is shared between the different transposases, therefore the piggyBac (PB) is described as an example. PB is a 2.5 kb insect transposon originally isolated from the cabbage looper moth, *Trichoplusia ni*. The PB transposon consists of asymmetric terminal repeat sequences that flank a transposase, PBase. PBase recognizes the terminal repeats and induces transposition via a "cut-and-paste" based mechanism, and preferentially transposes into the host genome at the tetranucleotide sequence TTAA. Upon insertion, the TTAA target site is duplicated such that the PB transposon is flanked by this tetranucleotide sequence. When mobilized, PB typically excises itself precisely to reestablish a single TTAA site, thereby restoring the host sequence to its pre-transposon state. After excision, PB can transpose into a new location or be permanently lost from the genome. Typically, the transposase system offers an alternative means for the removal of selection cassettes after homologous recombination similar to the use Cre/Lox or Flp/FRT. Thus, for example, the PB transposase system involves introduction of a targeting vector with 3' and 5' homology arms containing the mutation of interest, two PB terminal repeat sequences at the site of an endogenous TTAA sequence and a selection cassette placed between PB terminal repeat sequences. Positive selection is applied and homologous recombinants that contain targeted mutation are identified. Transient expression of PBase removes in conjunction with negative selection results in the excision of the selection cassette and selects for cells where the cassette has been lost. The final targeted allele contains the introduced mutation with no exogenous sequences.

For PB to be useful for the introduction of sequence alterations, there must be a native TTAA site in relatively close proximity to the location where a particular mutation is to be inserted.

Homology Directed Repair (HDR) Homology Directed Repair (HDR) can be used to generate specific nucleotide changes (also known as gene "edits") ranging from a single nucleotide change to large insertions. In order to utilize HDR for gene editing, a DNA "repair template" containing the desired sequence must be delivered into the cell type of interest with e.g. the guide RNA [gRNA(s)] and Cas9 or Cas9 nickase or other genome editing method (examples herein below). The repair template must contain the desired edit as well as additional homologous sequence immediately upstream and downstream of the target (termed left and right homology arms). The length and binding position of each homology arm is dependent on the size of the change being introduced. The repair template can be a single stranded oligonucleotide, double-stranded oligonucleotide, or double-stranded DNA plasmid depending on the specific application.

The HDR method was successfully used for targeting a specific modification in a coding sequence of a gene in plants [Budhagatapalli Nagaveni et al. (2015) "Targeted Modification of Gene Function Exploiting Homology-Directed Repair of TALEN-Mediated Double-Strand Breaks in Barley". G3 (Bethesda). 5(9): 1857-1863). Thus, the gfp-specific transcription activator-like effector nucleases were used along with a repair template that, via HDR, facilitates conversion of gfp into yfp, which is associated with a single amino acid exchange in the gene product. The resulting yellow-fluorescent protein accumulation along with sequencing confirmed the success of the genomic editing.

Similarly, Zhao Yongping et al. 2016 (An alternative strategy for targeted gene replacement in plants using a dual-sgRNA/Cas9 design. Scientific Reports 6, Article number: 23890 (2016)) describe co-transformation of *Arabidopsis* plants with a combinatory dual-sgRNA/Cas9 vector that successfully deleted miRNA gene regions (MIR169a and MIR827a) and second construct that contains sites homologous to *Arabidopsis* TERMINAL FLOWER 1 (TFL1) for homology-directed repair (HDR) with regions corresponding to the two sgRNAs on the modified construct to provide both targeted deletion and donor repair for targeted gene replacement by HDR.

Specific considerations for Homology Directed Repair (HDR) utilizing CRISPR/Cas9 system are described herein: It should be noted that the repair template should not include a sequence that exhibits more than 90% identity to the gRNA designed to the genomic DNA or to the reverse complement sequence of the gRNA which is designed to the genomic sequence, otherwise the repair template becomes a suitable target for Cas9 cleavage. Additionally or alternatively, when using a short repair template (e.g., about 40-200 base pairs) the repair template should preferably lack the Protospacer Adjacent Motif (PAM) sequence. For example, the PAM could be mutated such that it is no longer present, but the coding region of the gene is not affected (i.e. a silent mutation).

Introduction of large double stranded DNA as repair template can be performed using plasmids, yet, the plasmid should be linearized before transfection.

Activation of Target Genes Using CRISPR/Cas9 System

Many bacteria and archea contain endogenous RNA-based adaptive immune systems that can degrade nucleic acids of invading phages and plasmids. These systems consist of clustered regularly interspaced short palindromic repeat (CRISPR) genes that produce RNA components and CRISPR associated (Cas) genes that encode protein components. The CRISPR RNAs (crRNAs) contain short stretches of homology to specific viruses and plasmids and act as guides to direct Cas nucleases to degrade the complementary nucleic acids of the corresponding pathogen. Studies of the type II CRISPR/Cas system of *Streptococcus pyogenes* have shown that three components form an RNA/protein complex and together are sufficient for sequence-specific nuclease activity: the Cas9 nuclease, a crRNA containing 20 base pairs of homology to the target sequence, and a trans-activating crRNA (tracrRNA) (Jinek et al. Science (2012) 337: 816-821). It was further demonstrated that a synthetic chimeric guide RNA (gRNA) composed of a fusion between crRNA and tracrRNA could direct Cas9 to cleave DNA targets that are complementary to the crRNA in vitro. It was also demonstrated that transient expression of CRISPR-associated endonuclease (Cas9) in conjunction with synthetic gRNAs can be used to produce targeted double-stranded brakes in a variety of different species.

The CRISPR/Cas9 system is a remarkably flexible tool for genome manipulation. A unique feature of Cas9 is its ability to bind target DNA independently of its ability to cleave target DNA. Specifically, both RuvC- and HNH-nuclease domains can be rendered inactive by point mutations (D10A and H840A in SpCas9), resulting in a nuclease dead Cas9 (dCas9) molecule that cannot cleave target DNA. The dCas9 molecule retains the ability to bind to target DNA based on the gRNA targeting sequence. The dCas9 can be tagged with transcriptional activators, and targeting these dCas9 fusion proteins to the promoter region results in robust transcription activation of downstream target genes. The simplest dCas9-based activators consist of dCas9 fused directly to a single transcriptional activator. Importantly, unlike the genome modifications induced by Cas9 or Cas9 nickase, dCas9-mediated gene activation is reversible, since it does not permanently modify the genomic DNA.

Indeed, genome editing was successfully used to overexpress a protein of interest in a plant by, for example, mutating a regulatory sequence, such as a promoter to overexpress the endogenous polynucleotide operably linked to the regulatory sequence. For example, U.S. Patent Application Publication No. 20160102316 to Rubio Munoz, Vicente et al., describes plants with increased expression of an endogenous DDA1 plant nucleic acid sequence wherein the endogenous DDA1 promoter carries a mutation introduced by mutagenesis or genome editing which results in increased expression of the DDA1 gene, using for example, CRISPR. The method involves targeting of Cas9 to the specific genomic locus, in this case DDA1, via a 20-nucleotide guide sequence of the single-guide RNA. An online CRISPR Design Tool can identify suitable target sites (tools.genome-engineering.org; Ran et al. (2013) Nature Protocols, 8911): 2281-2308).

The CRISPR-Cas system was used for altering (increasing or decreasing) gene expression in plants as described in U.S. Patent Application publication No. 20150067922 to Yang; Yinong et al. The engineered, non-naturally occurring gene editing system comprises two regulatory elements, wherein the first regulatory element (a) operable in a plant cell operably linked to at least one nucleotide sequence encoding a CRISPR-Cas system guide RNA (gRNA) that hybridizes with the target sequence in the plant, and a second regulatory element (b) operable in a plant cell operably linked to a nucleotide sequence encoding a Type-II CRISPR-associated nuclease, wherein components (a) and (b) are located on same or different vectors of the system, whereby the guide RNA targets the target sequence and the CRISPR-associated nuclease cleaves the DNA molecule, thus altering the expression of a gene product in a plant. It should be noted that the CRISPR-associated nuclease and the guide RNA do not naturally occur together.

In addition, as described above, point mutations which activate a gene-of-interest and/or which result in over-expression of a polypeptide-of-interest can be also introduced into plants by means of genome editing. Such mutation can be for example, deletions of repressor sequences which result in activation of the gene-of-interest; and/or mutations which insert nucleotides and result in activation of regulatory sequences such as promoters and/or enhancers.

According to additional aspect, the present invention provides a genetically engineered plant having enhanced resistance to at least one fungus of the genus *Mycosphaerella* and fungi related thereto compared to a control plant, the genetically engineered plant comprises at least one cell having modified expression and/or activity of at least one polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to a polypeptide having an amino acid sequence selected from the group consisting of SEQ ID NOs:160-260 compared to the polypeptide expression and/or activity in a control plant. Each possibility represents a separate embodiment of the present invention.

According to certain embodiments, the genetically engineered plant comprises at least one cell having modified expression and/or activity of at least one polypeptide having the amino acid sequence selected from the group consisting of SEQ ID NOs:160-261. Each possibility represents a separate embodiment of the present invention.

According to certain embodiments, the genetically engineered plant comprises at least one cell having modified expression of a polynucleotide encoding the at least one polypeptide.

According to additional aspect, the present invention provides a genetically engineered plant having enhanced resistance to at least one fungus of the genus *Mycosphaerella* and fungi related thereto compared to a control plant, the genetically engineered plant comprises at least one cell having modified expression of at least one polynucleotide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to a polynucleotide having an nucleic acid sequence selected from the group consisting of SEQ ID NOs:43-155 compared to the polypeptide expression and/or activity in a control plant. Each possibility represents a separate embodiment of the present invention.

According to certain embodiments, the genetically engineered plant comprises at least one cell having modified expression of at least one polynucleotide having the nucleic acid sequence selected from the group consisting of SEQ ID NOs:43-157. Each possibility represents a separate embodiment of the present invention.

According to certain embodiments, the genetically engineered plant having enhanced resistance to at least one fungus of the genus *Mycosphaerella* and fungi related thereto comprises at least one cell with enhanced expression and/or activity of the at least one polypeptide.

According to certain embodiments, the genetically engineered plant comprises at least one cell transformed with an exogenous polynucleotide encoding the at least one polypeptide, thereby having an enhanced resistance to the at least one fungus. The exogenous polynucleotide can be endogenous to the plant cell or heterologous to the plant cell.

According to certain embodiments, the genetically engineered plant comprises at least one cell edited to express an exogenous polynucleotide encoding the at least one polypeptide, thereby having an enhanced resistance to the at least one fungus.

According to certain embodiments, the genetically engineered plant having enhanced resistance to the at least one fungus comprises at least one cell with enhanced expression of a polynucleotide encoding the at least one polypeptide. According to certain exemplary embodiments, the polynucleotide expression in the genetically engineered plant is enhanced in comparison to the polynucleotide expression in a control plant.

According to certain exemplary embodiments, the at least one polypeptide having enhanced expression and/or activity comprises an amino acid sequence at least 80% identical to an amino acid sequence selected from the group consisting of SEQ ID NOs:160, 163-164, 171-172, 175-176, 178, 181-182, 189. According to certain embodiments, the polypeptide comprises an amino acid sequence selected from the group consisting of SEQ ID NOs:160, 163-164, 171-172, 175-176, 178, 181-182, 189, 261. Each possibility represents a separate embodiment of the present invention.

According to certain embodiments, the at least one polypeptide is encoded by a polynucleotide having a nucleic acid sequence at least 80% identical to a nucleic acid sequence selected from the group consisting of SEQ ID NOs:43, 46-47, 54-55, 58-59, 61, 64-65, 72-73, 76-77. According to some embodiments, the at least one polypeptide is encoded by a nucleic acid sequence selected from the group consisting of SEQ ID NOs:43, 46-47, 54-55, 58-59, 61, 64-65, 72-73, 76-77, 156-157.

According to certain embodiments, the genetically engineered plant having enhanced resistance to at least one fungus of the genus *Mycosphaerella* and fungi related thereto comprises at least one cell with reduced expression and/or activity of the at least one polypeptide. According to certain exemplary embodiments, the polypeptide expression and/or activity in the genetically engineered plant is reduced in comparison to the polypeptide expression and/or activity in a control plant.

According to certain embodiments, the genetically engineered plant having reduced expression and/or activity of the at least one polypeptide comprises at least one cell having reduced expression of a polynucleotide encoding said at least one polypeptide, thereby having an enhanced resistance to the at least one fungus.

According to certain embodiments, the genetically engineered plant comprises a polynucleotide encoding a modified form of the at least one polypeptide, wherein the modified form has reduced or no activity compared to the unmodified form, thereby having an enhanced resistance to the at least one fungus.

Once expression is modified within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

It will be appreciated that some genes involved in plant defense mechanisms conferring resistance to a particular fungus species may also be involved in resistance to other species, regulated by the same or homologous genes. Of course, the overall defense mechanism is related, not identical, and therefore not all genes involved in resistance to one pathogen will confer resistance to other pathogens. Nonetheless, if a gene confers or enhances resistance to one of the pathogen species, it would be apparent to one skilled in the art to test for resistance to other pathogens, specifically to pathogen of the same genus or that cause similar symptoms.

According to certain embodiments, the at least one fungus of the genus *Mycosphaerella* is selected from the group consisting of *M. fijiensis, M. musicola, M. eumusae, M. graminicola, M. caffeicola, M. zeae maydis, M. areola, M. linicola, M. brassicola, M. cryptic, M. platanicola, M. citri, M. pomi, M. fragariae, M. rosicola* and combinations thereof. Each possibility represents a separate embodiment of the present invention. According to these embodiments, the plant species is selected from the group consisting of *Musa* species, wheat, *Coffea*, maize, cotton, flax, plants of the Brassicaceae family (including cauliflower, Brussel sprouts and cabbage); strawberry; rose; and trees of the *Citrus* species (including lemon, grapefruit, mandarin, kumquats and navel orange), *Coffea* species, *Eucalyptus, Platanus* species and Apple.

According to certain exemplary embodiments, the plant is of the genus *Musa* and the pathogenic fungus is selected from the group consisting of *M. fijiensis, M. musicola, M. eumusae, Fusarium oxysporum* f. sp. *Cubense, Fusarium pallidoroseum, Colletotrichum musae, Verticillium theobromae, Cylindrocarpon musae, Pestalotiopsis disseminate, Curvularia eragrostidis, Cercospora hayi, Pestalotiopsis leprogena*, and any combination thereof. Each possibility represents a separate embodiment of the present invention.

According to certain exemplary embodiments, the plant is of the genus *Musa* and the pathogenic fungus is selected from the group consisting of *M. fijiensis, M. musicola, M. eumusae* causing Sigatoka disease complex. According to some embodiments, the pathogenic fungus is *M. fijiensis* causing black Sigatoka or black leaf streak disease. According to some embodiments, the pathogenic fungus is *M. musicola*, causing yellow Sigatoka disease. According to some embodiments, the pathogenic fungus is *M. eumusae*, causing eumusae leaf spot disease.

According to certain exemplary embodiments, the plant is banana plant of the Cavendish subgroup.

According to certain exemplary embodiments, the plant is a wheat plant and the pathogenic fungus is *M. graminicola*, causing the wheat blotch disease.

According to certain exemplary embodiments, the plant is of the genus *coffea* and the pathogenic fungus is *M. caffeicola*, causing leaf spot disease.

According to certain exemplary embodiments, the plant is *Zea mays* and the pathogenic fungus is *M. zeae maydis*, causing Yellow leaf blight disease.

According to certain exemplary embodiments, the plant is cotton plant and the pathogenic fungus is *M. areola*, causing leaf blight disease.

According to certain exemplary embodiments, the plant is flax plant and the pathogenic fungus is *M. linicola*, causing Pasmo disease.

According to certain exemplary embodiments, the plant is of the family Brassicaceae and the pathogenic fungus is *M. brassicola*, causing ring spot disease.

According to certain exemplary embodiments, the plant is Eucalyptus and the pathogenic fungus is *M. cryptica*, causing leaf spot disease.

According to certain exemplary embodiments, the plant is a species of *Platanus* and the pathogenic fungus is *M. platanicola*, causing leaf spot disease.

According to certain exemplary embodiments, the plant is a species of *Citrus* and the pathogenic fungus is *M. citri*, causing greasy spot disease.

According to certain exemplary embodiments, the plant is apple tree and the pathogenic fungus is *M. pomi* causing black spot disease.

According to certain exemplary embodiments, the plant is strawberry and the pathogenic fungus is *M. fragariae* causing common leaf spot disease.

According to certain exemplary embodiments, the plant is a rose plant and the pathogenic fungus is *M. rosicola* causing leaf spot disease.

The term "plant" as used herein encompasses a whole plant, a grafted plant, ancestor(s) and progeny of the plants and plant parts, including seeds, shoots, stems, roots (including tubers), rootstock, scion, and plant cells, tissues and organs. The plant or part thereof may be in any form including suspension cultures, embryos, meristematic regions, callus tissue, leaves, gametophytes, sporophytes, pollen, and microspores.

According to some embodiments of the invention the plant is a dicotyledonous plant.

According to some embodiments of the invention the plant is a monocotyledonous plant.

According to additional aspect, the present invention provides an isolated polynucleotide encoding a polypeptide at least about 80%, at least about 81%, at least about 82%, at least about 83%, at least about 84%, at least about 85%, at least about 86%, at least about 87%, at least about 88%. at least about 89%. at least about 90%, at least about 91%, at least about 92%. at least about 93%, at least about 93%, at least about 94%, at least about 95%, at least about 96%, at least about 97%, at least about 98%, at least about 99% or more homologous, or identical to an amino acid sequence selected from the group consisting of SEQ ID NOs:160-260. According to certain embodiments, the present invention provides an isolated polynucleotide encoding a polypeptide comprising the amino acid sequence set forth in any one of SEQ ID NOs:160-261. According to additional embodiments, the present invention provides an isolated polypeptide consisting of the amino acid sequence set forth in any one of SEQ ID NOs:160-261.

According to additional aspect, the present invention provides an isolated polynucleotide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to a nucleic acid sequence selected from the group consisting of SEQ ID NOs:43-155. According to certain embodiments, the present invention provides an isolated polynucleotide comprising the nucleic acid sequence set forth in any one of SEQ ID NOs:43-157. According to additional embodiments, the present invention provides an isolated polynucleotide consisting of the nucleic acid sequence set forth in any one of SEQ ID NOs:43-157.

According to certain embodiments of the invention, the exogenous polynucleotide is a non-coding RNA.

As used herein the phrase "non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

The invention also encompasses fragments of the above described polypeptides and polypeptides having mutations, such as deletions, insertions or substitutions of one or more amino acids, either naturally occurring or man induced, either randomly or in a targeted fashion.

The invention further encompasses the nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The isolated polynucleotides and polypeptides of the present invention and the fragment thereof are capable of conferring and/or increasing the resistance of a plant to at least one pathogenic fungus of the genus *Mycosphaerella* and fungi related thereto.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

The following examples are presented in order to more fully illustrate some embodiments of the invention. They should, in no way be construed, however, as limiting the broad scope of the invention. One skilled in the art can readily devise many variations and modifications of the principles disclosed herein without departing from the scope of the invention.

EXAMPLES

Example 1: Resistance to Fungal Infection—Genes Identification

The inventors of the present invention have identified polynucleotides related to the resistance of plants to fungal infection, particularly to infection by *Mycosphaerella fijiensis*. Altered expression of the polynucleotide and/or encoded polypeptide in plants can increase the plant resistance to fungal infection.

The nucleotide sequence datasets used for the polynucleotide identification were originated from publicly available databases as well as from Applicant proprietary sequencing data obtained using the Solexa/ILLUMINA technology or the 454-sequencing platform (Nat Rev Genet. 2010 January; 11(1):31-46. doi: 10.1038/nrg2626) for banana varieties. Sequence data from 200 different plant species were introduced into a single, comprehensive database. The information used to build the datasets included gene expression levels, protein annotation, enzymatic activity and involvement in biosynthetic pathways.

Major databases used included:
Genomic Databases
  Banana Genome Hub [*Musa acuminata* DH zPahang v2 (banana-genome-hub.southgreen.fr)]
  *Arabidopsis* genome [TAIR genome version 6 (arabidopsis.org/)];
  Rice genome [IRGSP build 4.0 (rgp.dna.affrc.go. jp/IRGSP/)];
  Poplar [*Populus trichocarpa* release 1.1 from JGI (assembly release v1.0) (genome.jgi-psforg/)];
  *Brachypodium* [JGI 4× assembly, brachpodium.org)];
  Soybean [DOE-JGI SCP, version Glyma0 (phytozome.net/)];
  Grape [French-Italian Public Consortium for Grapevine Genome Characterization grapevine genome (genoscope.cns.fr/)];
  Castorbean [TIGR/J Craig Venter Institute 4× assembly [msc.jcvi.org/r communis];
  *Sorghum* [DOE-JGI SCP, version Sbil [phytozome.net/)]; and
  Maize "B73" [DOE-JGI SCP, version AGPv2 [phytozome.net/)];
Databases of Expressed EST and mRNA Sequences:
  GenBank ncbi.nlm.nih.gov/dbEST;
  RefSeq (ncbi.nlm.nih.gov/RefSeq/);
  TAIR (arabidopsis.org/);
Protein and Pathway Databases:
  Uniprot [uniprot.org/];
  AraCyc [arabidopsis.org/biocyc/index.jsp];
  ENZYME [expasy.org/enzyme/];
  Microarray datasets were downloaded from: GEO (ncbi.nlm.nih.gov/geo/); TAIR (arabidopsis.org/); and Applicant proprietary microarray data as described in PCT Patent Application Publication No. WO 2008/122980.
  QTL and SNPs information was retrieved from Gramene [gramene.org/qtl/]; and Panzea [panzea.org/index.html].
Database Assembly
  Database assembly was performed to build a wide, rich, reliable annotated and easy to analyze database. The assembly comprised data retrieved from publicly available genomic sequences, mRNA sequences, expressed sequences tages (ESTs) DNA sequences and quantitative trait loci (QTL) data, as well as information regarding gene expression, protein annotation, and involvement in biosynthesis pathway, all in various plant types. The assembly further comprised data retrieved from Applicant's proprietary databases produced from various plant types including genomic sequences, mRNA sequences, information regarding gene expression, proteomic and metabolomic data, QTL and GWAS (genome-wide association studies) data.

Database assembly is comprised of a toolbox of gene refining, structuring and annotation as well as analysis tools enabling to construct a tailored database for each gene discovery project. Gene refining and structuring tools enable to reliably detect splice variants and antisense transcripts, and understand various potential phenotypic outcomes of a single gene. The capabilities of the "LEADS" platform of Compugen LTD. for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST Clustering and Gene Assembly

For gene clustering and assembly of organisms with available genome sequence data (banana, *Arabidopsis*, rice, castorbean, grape, *Brachypodium*, poplar, soybean, sorghum) the genomic LEADS version (GANG) was employed. This tool allows most accurate clustering of ESTs and mRNA sequences on a genome, and predicts gene structure as well as alternative splicing events and antisense transcription.

For organisms with no available full genome sequence data, "expressed LEADS" clustering software was applied.

Gene Annotation

Predicted genes and proteins were annotated as follows: BLAST™ search [blast.ncbi.nlm.nih.gov/Blast.cgi] against all plant UniProt [uniprot.org/] sequences was performed. Open reading frames (ORFs) of each putative transcript were analyzed and longest ORF with highest number of homologues was selected as a predicted protein of the transcript. The predicted proteins were analyzed by InterPro [ebi.ac.uk/interpro].

BLAST™ against proteins from AraCyc and ENZYME databases was used to map the predicted transcripts to AraCyc pathways.

Predicted proteins from different species were compared using BLAST™ algorithm [ncbi.nlm.nih.gov/Blast.cgi] to validate the accuracy of the predicted protein sequence, and for efficient detection of orthologs.

Gene Expression Profiling

Several data sources were exploited for gene expression profiling, namely microarray data and digital expression profile (see below). Genes and their orthologs were analyzed for expression patterns in different plant species and varieties. The analysis was based on differential expression under uninfected and infected conditions. Publicly available microarray datasets were downloaded from TAIR and NCBI GEO sites, renormalized, and integrated into the database. Expression profiling is one of the most important resource data for identifying genes related to disease resistance.

A digital expression profile summary was compiled for each gene cluster according to all keywords included in the sequence records comprising the cluster. Digital expression, also known as electronic Northern Blot, is a tool that displays virtual expression profile based on the EST sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis of The Melon Fruit Transcriptome Based on 454 Pyrosequencing, in: Plant & Animal Genomes XVII Conference, San Diego, Calif.). Transcriptomeic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [icugi.org/] confirmed the accuracy of the sequencing and assembly. Expression patterns of selected genes fitted well their qRT-PCR data.

Genes the expression of which was altered (decreased or increased) in banana plants in response to infection with *Mycosphaerella fifiensis* or gene orthologs the expression of which was affected in other species by close related pathogens, were identified utilizing the database described above and by utilizing transcriptome data and mining criteria as described in Examples 3-4 hereinbelow. These genes are candidate to have a major impact on banana resistance to *Mycosphaerella fijiensis*. The name of the identified gene, the plant from which each gene is derived and its amino acid and nucleic acid sequences are summarized in Table 1 hereinbelow.

TABLE 1

Genes associated with resistance to fungal infection

| Gene Name | Organism | Polyn. SEQ ID NO: | Polyp. SEQ ID NO: |
|---|---|---|---|
| BAN3 | Musa acuminata | 43 | 160 |
| BAN5 | Musa acuminata | 44 | 161 |
| BAN6 | Musa acuminata | 45 | 162 |
| BAN7 | Musa acuminata | 156 | 261 |
| BAN8 | Musa acuminata | 46 | 163 |
| BAN11 | Musa acuminata | 47 | 164 |
| BAN12 | Musa acuminata | 48 | 165 |
| BAN18 | Musa acuminata | 49 | 166 |
| BAN22 | Musa acuminata | 50 | 167 |
| BAN24 | Musa acuminata | 51 | 168 |
| BAN26 | Musa acuminata | 52 | 169 |
| BAN29 | Musa acuminata | 53 | 170 |
| BAN34 | Musa acuminata | 54 | 171 |
| BAN36 | Musa acuminata | 55 | 172 |
| BAN41 | Zea mays | 56 | 173 |
| BAN43 | Triticum aestivum | 57 | 174 |
| BAN44 | Triticum aestivum | 58 | 175 |

TABLE 1-continued

Genes associated with resistance to fungal infection

| Gene Name | Organism | Polyn. SEQ ID NO: | Polyp. SEQ ID NO: |
|---|---|---|---|
| BAN46 | Triticum aestivum | 59 | 176 |
| BAN47 | Oryza sativa | 60 | 177 |

"polyn." = polynucleotide; "polyp." = polypeptide.

Example 2: Resistance to Fungal Infection—Identification of Homologous Sequences The concepts of orthology and paralogy have recently been applied to functional characterization and classification on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To further investigate and identify putative orthologs of the genes identified to affect plant resistance to *Mycosphaerella fijiensis* all sequences were aligned using the BLAST™ (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data were analyzed and the EST libraries were classified using a fixed vocabulary of custom terms such as developmental stages (e.g., genes showing similar expression profile through development with up-regulation at specific stage, such as at seed germination, time points during seedling growth and at maturity) and/or plant organ (e.g., genes showing similar expression profile across their organs with up-regulation at specific organs such as leaves roots and stems). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, including similarities in the sequence level—identical amino acids in the protein domains and similarity in expression profiles.

The search and identification of homologous genes involves the screening of sequence information available, for example, in public databases such as the DNA Database of Japan (DDBJ), GenBank, and the European Molecular Biology Laboratory Nucleic Acid Sequence Database (EMBL) or versions thereof or the MIPS database. A number of different search algorithms have been developed, including but not limited to the suite of programs referred to as BLAST™ programs. There are five implementations of BLAST™, three designed for nucleotide sequence queries (BLASTN, BLASTX, and TBLASTX) and two designed for protein sequence queries (BLASTP and TBLASTN) (Altschul, S. F. et al., (1990) "Basic local alignment search tool." J. Mol. Biol. 215:403-410). Such methods involve alignment and comparison of sequences. The BLAST™ algorithm calculates percent sequence identity and performs a statistical analysis of the similarity between the two sequences. The software for performing BLAST™ analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48:443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis, one may use standard programs for multiple alignments (e.g. MUSCLE (2004) Nucleic acids research 32(5):1792-1797). A neighbor-joining tree of the proteins homologous to the proteins encoded by the genes identified in this invention may be used to provide an overview of structural and ancestral relationships. Sequence identity may be calculated using an alignment program as described above. It is expected that plants other than those examined in the present invention, which are affected by *M. fijiensis* variants and fungi related thereto will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), *Arabidopsis* (*Arabidopsis thaliana*), maize (*Zea mays*), cotton (*Gossypium*), Oilseed rape (*Brassica napus*), Rice (*Oryza sativa*), Sugar cane (*Saccharum officinarum*), *Sorghum* (*Sorghum bicolor*), Soybean (*Glycine max*), Sunflower (*Helianthus annuus*), Tomato (*Lycopersicon esculentum*), and Wheat (*Triticum aestivum*).

The above-mentioned analyses for sequence homology can be carried out on a full-length sequence, but may also be based on a comparison of certain regions such as conserved domains. The identification of such domains would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (biochem.ucl.ac.uk/bsm/dbbrowser/protocol/prodomgry.html), PIR (pir.Georgetown.edu/) or Pfam (sanger.ac.uk/Software/Pfam/) databases. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break α-helical structures or β-sheet structures). Conservative Substitution Tables are well known in the art (see for example Creighton T E (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified core genes described in Table 1 (Example 1) were identified from the databases using BLAST™ software with the Blastp and tBlastn algorithms as filters for the first stage, and the needle (EMBOSS package) or Frame+ algorithm alignment for the second stage. Local identity (BLAST™ alignments) was defined with a very permissive cutoff—60% Identity on a span of 60% of the sequences length because it is used only as a filter for the global alignment stage. The default filtering of the BLAST™ package was not utilized (by setting the parameter "-F F").

In the second stage, homologs were defined based on a global identity of at least 80% to the core gene polypeptide encoded sequence. Two distinct forms for finding the optimal global alignment for protein or nucleotide sequences were used in this application:

1. Between two proteins (following the BLASTP filter):
EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the TBLASTN filter):
GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options described hereinabove.

The query polypeptide sequences were the sequences listed in Table 1 (Example 1). The subject sequences are protein sequences identified in the database based on greater than 80% global identity to the predicted translated sequences of the query nucleotide sequences or to the polypeptide sequences. Homology was calculated as % of identity over the aligned sequences. The identified orthologous and homologous sequences having at least 80% global sequence identity to said sequences are provided in Table 2 hereinbelow. These homologous genes are expected to increase plant resistance to fungal infection caused by the mentioned pathogens of the genus *Mycosphaerella* and pathogenic fungi related thereto.

TABLE 2

Homologues (e.g., orthologues) of genes associated with banana resistance to the fungus *Mycosphaerella fijiensis*

| P.N. SEQ ID NO: | Hom. to Gene Name | Organism | P.P. SEQ ID NO: | Hom. to SEQ ID NO: | % glob. Iden. | Algor. |
|---|---|---|---|---|---|---|
| 85 | BAN12 | *Musa acuminata* | 198 | 165 | 99.39 | globlastp |
| 87 | BAN22 | *Musa acuminata* | 200 | 167 | 99.04 | globlastp |
| 88 | BAN22 | *Phoenix dactylifera* | 201 | 167 | 84.26 | globlastp |
| 89 | BAN22 | *Cocos nucifera* | 202 | 167 | 84.1 | globlastp |
| 90 | BAN22 | *Elaeis guineensis* | 203 | 167 | 84.1 | globlastp |
| 91 | BAN22 | *Elaeis guineensis* | 204 | 167 | 84.08 | globlastp |
| 92 | BAN22 | *Elaeis guineensis* | 205 | 167 | 83.94 | globlastp |
| 93 | BAN22 | *Elaeis guineensis* | — | 167 | 83.92 | glotblastn |
| 94 | BAN22 | *Phoenix dactylifera* | 206 | 167 | 82.96 | globlastp |
| 95 | BAN22 | *Musa acuminata* | 207 | 167 | 81.6 | globlastp |
| 96 | BAN22 | *Ananas comosus* | 208 | 167 | 81.57 | globlastp |
| 97 | BAN22 | *Ananas comosus* | 209 | 167 | 81.4 | globlastp |
| 98 | BAN22 | *Amorphophallus konjac* | 210 | 167 | 80.3 | globlastp |
| 99 | BAN22 | *Phoenix dactylifera* | 211 | 167 | 80.25 | globlastp |
| 111 | BAN43 | *Hordeum vulgare* | 222 | 174 | 83.36 | globlastp |
| 112 | BAN43 | *Aegilops tauschii* | 223 | 174 | 81.1 | globlastp |
| 79 | BAN5 | *Musa acuminata* | 192 | 161 | 98.77 | globlastp |
| 153 | BAN36 | *Musa acuminata* | 258 | 189 | 98.25 | globlastp |
| 86 | BAN18 | *Musa acuminata* | 199 | 166 | 99.48 | globlastp |
| 82 | BAN8 | *Musa acuminata* | 195 | 163 | 97.83 | globlastp |
| 158 | BAN7 | *Platanus occidentalis* | 262 | 261 | 81.6 | globlastp |
| 159 | BAN7 | *Vitis vinifera* | — | 261 | 80.56 | glotblastn |
| 110 | BAN41 | *Zea mays* | 221 | 173 | 98.46 | globlastp |
| 155 | BAN43 | *Aegilops tauschii* | 260 | 191 | 99.5 | globlastp |
| 151 | BAN26 | *Musa acuminata* | 256 | 187 | 86.7 | globlastp |
| 152 | BAN26 | *Elaeis guineensis* | 257 | 187 | 80.14 | globlastp |
| 83 | BAN11 | *Musa acuminata* | 196 | 164 | 99.12 | globlastp |
| 84 | BAN11 | *Musa acuminata* | 197 | 164 | 80.1 | globlastp |
| 113 | BAN44 | *Aegilops tauschii* | 224 | 175 | 99.1 | globlastp |
| 114 | BAN44 | *Triticum aestivum* | 225 | 175 | 93.6 | globlastp |
| 115 | BAN44 | *Pseudoroegneria spicata* | 226 | 175 | 89.6 | globlastp |
| 116 | BAN44 | *triticum urartu* | 227 | 175 | 87.5 | globlastp |
| 117 | BAN44 | *Hordeum vulgare* | 228 | 175 | 86.1 | globlastp |
| 118 | BAN44 | *Hordeum vulgare* | 229 | 175 | 83.04 | globlastp |
| 119 | BAN44 | *Aegilops tauschii* | 230 | 175 | 81.7 | globlastp |
| 120 | BAN44 | *Secale cereale* | 231 | 175 | 81.3 | globlastp |
| 121 | BAN44 | *Hordeum vulgare* | 232 | 175 | 80.43 | globlastp |
| 122 | BAN44 | *Hordeum vulgare* | 233 | 175 | 80.4 | globlastp |
| 123 | BAN44 | *Triticum aestivum* | 234 | 175 | 80 | globlastp |

TABLE 2-continued

Homologues (e.g., orthologues) of genes associated with banana resistance to the fungus *Mycosphaerella fijiensis*

| P.N. SEQ ID NO: | Hom. to Gene Name | Organism | P.P. SEQ ID NO: | Hom. to SEQ ID NO: | % glob. Iden. | Algor. |
|---|---|---|---|---|---|---|
| 124 | BAN44 | *Secale cereale* | — | 175 | 80 | glotblastn |
| 154 | BAN41 | *Zea mays* | 259 | 190 | 98.72 | globlastp |
| 105 | BAN29 | *Musa acuminata* | 216 | 170 | 99.25 | globlastp |
| 106 | BAN29 | *Musa acuminata* | 217 | 170 | 81.3 | globlastp |
| 107 | BAN29 | *Musa acuminata* | 218 | 170 | 80.79 | globlastp |
| 108 | BAN36 | *Musa acuminata* | 219 | 172 | 85.6 | globlastp |
| 109 | BAN36 | *Musa acuminata* | 220 | 172 | 85.05 | globlastp |
| 80 | BAN6 | *Musa acuminata* | 193 | 162 | 97.62 | globlastp |
| 81 | BAN6 | *Musa acuminata* | 194 | 162 | 80 | globlastp |
| 125 | BAN46 | *Triticum aestivum* | 176 | 176 | 100 | globlastp |
| 126 | BAN46 | *Avena sativa* | — | 176 | 95.83 | glotblastn |
| 127 | BAN46 | *Secale cereale* | 235 | 176 | 80.6 | globlastp |
| 128 | BAN46 | *Aegilops tauschii* | 236 | 176 | 80.4 | globlastp |
| 100 | BAN24 | *Musa acuminata* | 212 | 168 | 98.94 | globlastp |
| 101 | BAN24 | *Musa acuminata* | 213 | 168 | 80.6 | globlastp |
| 102 | BAN24 | *Musa acuminata* | 214 | 168 | 80.2 | globlastp |
| 103 | BAN24 | *Musa acuminata* | 215 | 168 | 80.17 | globlastp |
| 145 | BAN11 | *Musa acuminata* | — | 182 | 85.59 | glotblastn |
| 146 | BAN11 | *Musa acuminata* | 251 | 182 | 84.37 | globlastp |
| 147 | BAN11 | *Musa acuminata* | 252 | 182 | 83.63 | globlastp |
| 148 | BAN11 | *Musa acuminata* | 253 | 182 | 83.63 | globlastp |
| 149 | BAN11 | *Musa acuminata* | 254 | 182 | 83.6 | globlastp |
| 150 | BAN11 | *Musa acuminata* | 255 | 182 | 80.59 | globlastp |
| 129 | BAN47 | *Oryza sativa* | 177 | 177 | 100 | globlastp |
| 130 | BAN47 | *Oryza sativa* | 237 | 177 | 99.63 | globlastp |
| 129 | BAN47 | *Oryza sativa* | 238 | 177 | 95.29 | globlastp |
| 131 | BAN47 | *Oryza sativa* | 239 | 177 | 92.77 | globlastp |
| 132 | BAN47 | *Brachypodium distachyon* | 240 | 177 | 87.08 | globlastp |
| 133 | BAN47 | *Brachypodium distachyon* | 241 | 177 | 86.57 | globlastp |
| 134 | BAN47 | *Aegilops tauschii* | — | 177 | 86.48 | glotblastn |
| 135 | BAN47 | *foxtail millet* | 242 | 177 | 85.22 | globlastp |
| 136 | BAN47 | *Sorghum bicolor* | 243 | 177 | 84.74 | globlastp |
| 137 | BAN47 | *Brachypodium distachyon* | 244 | 177 | 84.7 | globlastp |
| 138 | BAN47 | *Secale cereale* | 245 | 177 | 84.2 | globlastp |
| 139 | BAN47 | *Avena sativa* | 246 | 177 | 83.8 | globlastp |
| 140 | BAN47 | *Zea mays* | 247 | 177 | 83.58 | globlastp |
| 141 | BAN47 | *Setaria italica* | 248 | 177 | 83 | globlastp |
| 142 | BAN47 | *Sorghum bicolor* | 249 | 177 | 82.5 | globlastp |
| 143 | BAN47 | *Avena sativa* | — | 177 | 82.29 | glotblastn |
| 144 | BAN47 | *Zea mays* | 250 | 177 | 80.8 | globlastp |
| 104 | BAN26 | *Musa acuminata* | 169 | 169 | 100 | globlastp |

"P.N." = polynucleotide;
"P.P." = polypeptide; "Algor." = algorithm (used for sequence alignment and determination of percent homology); "Hom."—homology; "iden."—identity; "glob."—global.

The output of the functional genomics approach described herein is a set of genes highly predicted to improve resistance of a plant to fungal infection by *Mycosphaerella fijiensis* when expressed, particularly overexpressed, in said plant. Although each gene is predicted to have its own impact, modifying the mode of expression of more than one gene is expected to provide an additive or synergistic effect on the plant resistance Altering the expression of each gene described herein alone or of a set of genes together increases the overall plant resistance, hence expects to increase agricultural productivity.

Example 3: Production of Plant Transcriptomes for Discovery of Genes Correlating with Resistance to Fungal Infection Experimental Procedures The association of gene expression with fungal infection was examined in several banana varieties presenting different reactions to *M. fijiensis* infection as described in Table 3. Tissues from leaves were sampled from plants growing under natural infection conditions. As controls, tissues were sampled from the five first leaves of banana plants growing in an uninfected environment (Israel). Leaves infection was rated from 0—youngest leaves with no infection to 5-leaves with clear necrosis. Infection rate of from 0 to 2 classified the banana variety as resistant; infection rate of from 3 to 5 classified the banana variety as sensitive.

TABLE 3

Banana varieties used for production of transcriptomic data and their phenotypic response to *M. fijiensis* infection

| Variety | Response to *M. fijiensis* |
|---|---|
| Calcutta - C4 | Resistant |
| Yute | Resistant |
| Grande Naine GN | Sensitive |

RNA Extraction

RNA extraction was performed using TRIzol Reagent of Invitrogen (invitrogen.com/content.cfm?pageid=469). Approximately 30-50 mg of leaf tissue were taken for the analysis. The weighed tissues were ground using pestle and mortar in liquid nitrogen and resuspended in 500 μl of TRIzol Reagent. To the homogenized lysate, 100 μl of chloroform were added followed by precipitation using isopropanol and two washes with 75% ethanol. The RNA was eluted in 30 μl of RNase-free water. RNA samples were cleaned up using Qiagen's RNeasy minikit clean-up protocol as per the manufacturer's protocol (QIAGEN Inc., CA USA).

Production of Banana Plant Transcriptome

The association of gene expression in Banana varieties with fungal infection was investigated utilizing a 44K banana oligonucleotide micro-array, produced by Agilent Technologies [chem.agilent.com/Scripts/PDS.asp?lPage=50879]. The array oligonucleotide represents about 28,000 banana genes and transcripts. To define association between the levels of RNA expression and plant resistance to M. fijiensis infection, parameters related to responses to fungal infection were analyzed in 3 different banana varieties under normal and infected conditions as described hereinabove (Table 3) designated as "resistant" and "sensitive".

Differential Expression Analysis

Dedicated datasets based on banana transcriptome and publicly available datasets related to transcriptomic of plants infected by fungal leaf pathogens were analyzed as described hereinabove. The analysis was performed via proprietary differential expression algorithm. The default query parameters used were: >2-fold change, p value<0.01, FDR<0.5. (FDR=false discovery rate). Stringency varied due to specific experimental context. The following queries were performed across species (aggregated through the use of proprietary ortholog determination), germplasm, organs, types of pathogens treated, and time post infection:

1. Up regulation upon infection: the gene's expression level is higher in infected samples than in mock controls (both resistant and susceptible varieties are queried).

2. Stronger expression induction in resistant varieties: the gene's expression induction is higher in resistant than in susceptible varieties upon infection.

3. Higher basal expression in resistant varieties: the gene's expression is higher in resistant than in susceptible varieties in uninfected samples.

No type of query is necessary nor sufficient but overall enrichment of positive indications is considered to identify genes significantly qualifying the above criteria.

The genes identified using the above differential expression analyses and the indications found per gene are described in Table 4 hereinbelow:

TABLE 4

Gene associated with resistance to M. fijiensis infection in banana and to other fungal pathogens in maize, wheat and rice

| Gene Name | Organism | Computational evidences |
|---|---|---|
| BAN3 | Musa acuminata | Associated to early infection responsive gene in Yute |
| BAN5 | Musa acuminata | Associated to upregulation in resistant varieties by infection, low expression in sensitive variety |
| BAN6 | Musa acuminata | Associated to early infection responsive gene in Yute |
| BAN7 | Musa acuminata | Associated to upregulation in resistant varieties by infection, low expression in sensitive variety |
| BAN8 | Musa acuminata | Associated to early infection responsive gene in Yute |
| BAN11 | Musa acuminata | Associated to early infection responsive gene in Yute |
| BAN12 | Musa acuminata | Associated to early infection responsive gene in Yute |
| BAN18 | Musa acuminata | Associated to early infection responsive gene in Yute |
| BAN22 | Musa acuminata | Associated to upregulation in resistant varieties by infection, low expression in sensitive variety |
| BAN24 | Musa acuminata | Associated to early infection responsive gene in Yute |
| BAN26 | Musa acuminata | Associated to early infection responsive gene in Yute |
| BAN29 | Musa acuminata | Associated to early infection responsive gene in Yute |
| BAN34 | Musa acuminata | Associated to upregulation in resistant varieties by infection, low expression in sensitive variety |
| BAN36 | Musa acuminata | Associated to early infection responsive gene in Yute |
| BAN41 | Zea mays | Associated to early defense responses in leaf maize resistant varieties infected by a smut fungus |
| BAN43 | Triticum aestivum | Associated to defense response in rust fungal infection in wheat leaves; form resistant variety |
| BAN44 | Triticum aestivum | Associated to defense response in rust fungal infection in wheat leaves; form resistant variety |
| BAN46 | Triticum aestivum | Associated to defense response in rust fungal infection in wheat leaves; form resistant variety |
| BAN47 | Oryza sativa | Associated to upregulation in resistant varieties by infection |

Short Description of the Identified Gene Mode of Action

BAN3: Beta-Glucosidase

β-glucosidases catalyze the selective cleavage of glucosidic linkages and are important enzymes in the plant defense response targeting the fungal pathogen cell wall BAN5: NAM Like Protein-Transcription Factor The NAC family of plant-specific transcriptional regulators (no apical meristem (NAM) proteins) are involved in the regulation of developmental processes, including formation of the shoot apical meristem, floral organs and lateral shoots, as well as in plant hormonal control and defense BAN6: Stress Induced Late Embryogenesis Abundant (LEA) Protein The function of proteins containing this domain in unknown but these proteins are expressed at different developmental stages and under conditions of biotic and abiotic stresses BAN7: Protein Kinase This protein is a serine/threonine kinase. Kinases are involved in the activation of the defense signaling cascade activated by recognition of a pathogen BAN8: Peroxidase Peroxidases are involved in the induction of mechanical related defense responses by modulation the lignification and suberization and cross-linking of cell wall components BAN11: Endoxyloglucan Transferase This class of enzymes are involved in the modification of the cell wall structure by cleaving and also re-joining xyloglucan molecules in primary plant cell walls thus contributing to mechanical related defense responses BAN12: Stress-Associated Zinc Finger Protein The zinc finger proteins are a super family of proteins involved in numerous activities of plant growth and development and are also known to regulate resistance mechanism for various biotic and abiotic stresses BAN18: Myb-Like Transcription Factor Members of this family function in a variety of plant-specific processes including regulation of defense responses BAN22: Signal Recognition Particle Receptor The signal recognition particle (SRP) is a multimeric protein, which along with its conjugate receptor (SR), is involved in targeting secretory proteins to the rough endoplasmic reticulum membrane in eukaryotes. Some of these are involved in the regulation of cell death related proteins BAN24: Similar to Leaf Senescence Protein This protein contains a sugar binding domain followed by an acyl esterase domain. Acyl esterase activity is linked to modification of cell-surface biopolymers such as glycans and glycoproteins such as those found in a fungus.

BAN26: Zinc Finger-Homeodomain Protein

The ZF-HD class of homeodomain proteins may also be involved in pathogen signaling and plant defense mechanisms.

BAN29: Alpha Galactosidase

Alpha-N-acetylgalactosaminidase catalyzes the hydrolysis of terminal non-reducing N-acetyl-D-galactosamine residues in N-acetyl-alpha-D-galactosaminides. This protein therefore could contribute to the plant defense by degrading the pathogen cell wall.

BAN34: Squamosa Promoter-Binding-Like Protein 9

SBP (for SQUAMOSA-pROMOTER BINDING PROTEIN) domain is a sequence specific DNA-binding domain found in plant proteins. Members of this family probably function as transcription factors involved in several processes including defense responses BAN36: Beta-Glucosidase β-glucosidases catalyze the selective cleavage of glucosidic linkages and are important enzymes in the plant defense response targeting the fungal pathogen cell wall BAN41: GDSL Esterase/Lipase GDSL esterases and lipases are hydrolytic enzymes with multifunctional properties and are also involved in plant defense responses linked to activation of lipid related signaling BAN43: Endo-1,3-Beta-Glucosidase O-Glycosyl hydrolases are a widespread group of enzymes that hydrolyze the glycosidic bond between two or more carbohydrates, or between a carbohydrate and a non-carbohydrate moiety and are important enzymes in the plant defense response targeting the fungal pathogen cell wall BAN44: Receptor Kinase 1

This protein is a Leucine-rich repeat (LRR) receptor kinase that could be involved in the activation of the defense signaling cascade initiated by pathogen recognition BAN46: Proteinase Inhibitor I12

Plants synthesize inhibitory polypeptides that can suppress the enzyme activities in response to attack by proteinases produced by phytopathogenic microorganisms which play an active role in the development of diseases BAN47: Tripeptidyl-Peptidase 2

This is an amino peptidase belonging to the subtilase family removing tripeptides from the free N terminus of oligopeptides. This could be related to the plant defense response by acting on pathogenicity factors of proteic nature secreted by the invading fungi Example 4: Identification of Domains Comprised within Identified Genes A polypeptide domain refers to a set of conserved amino acids located at specific positions along an alignment of sequences of evolutionarily related proteins. While amino acids at other positions can vary between homologues, amino acids that are highly conserved, and particularly amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom.

InterPro is hosted at the European Bioinformatics Institute in the United Kingdom. InterProScan is the software package that allows sequences (protein and nucleic) to be scanned against InterPro's signatures. Signatures are predictive models, provided by several different databases that make up the InterPro consortium.

InterProScan 5.11-51.0 was used to analyze the polypeptides of the present invention (core and homologues/orthologs) for common domains (Mitchell A et al., 2015. Nucleic Acids Research 43 (Database issue):D213-221; doi: 10.1093/nar/gku1243). Briefly, InterProScan is based on scanning methods native to the InterPro member databases. It is distributed with pre-configured method cut-offs recommended by the member database experts and which are believed to report relevant matches. All cut-offs are defined in configuration files of the InterProScan programs. Matches obtained with the fixed cut-off are subject to the following filtering:

Pfam filtering: Each Pfam family is represented by two hidden Markov models (HMMs) —ls and fs (full-length and fragment). An HMM model has bit score cut-offs (for each domain match and the total model match) and these are defined in the Gathering threshold (GA) lines of the Pfam database. Initial results are obtained with quite a high common cut-off and then the matches of the signature with a lower score than the family specific cut-offs are dropped. If both the fs and ls model for a particular Pfam hits the same region of a sequence, the AM field in the Pfam database is used to determine which model should be chosen—globalfirst(LS); localfirst(FS) or byscore (whichever has the highest e-value).

Another type of filtering has been implemented since release 4.1. It is based on Clan filtering and nested domains. Further information on Clan filtering can be found in the Pfam website (http://www.sanger.ac.uk/Pfam).

TIGRFAMs filtering: Each TIGRFAM HMM model has its own cut-off scores for each domain match and the total model match. These bit score cut-offs are defined in the "trusted cut-offs" (TC) lines of the database. Initial results are obtained with quite a high common cut-off and then the matches (of the signature or some of its domains) with a lower score compared to the family specific cut-offs are dropped.

PRINTS filtering: All matches with p-value more than a pre-set minimum value for the signature, are dropped.

SMART filtering: The publicly distributed version of InterProScan has a common e-value cut-off corresponding to the reference database size. A more sophisticated scoring model is used on the SMART web server and in the production of pre-calculated InterPro match data.

Exact scoring thresholds for domain assignments are proprietary data. The InterProMatches data production procedure uses these additional smart thresholds data. It is to be noted that the given cut-offs are e-values (i.e., the number of expected random hits) and therefore are only valid in the context of reference database size and of data files for filtering out results obtained with higher cut-off.

It implements the following logic: If the whole sequence E-value of a found match is worse than the 'cut_low', the match is dropped. If the domain E-value of a found match is worse than the 'repeat' cut-off (where defined) the match is dropped. If a signature is a repeat, the number of significant matches of that signature to a sequence must be greater than the value of 'repeats' in order for all matches to be accepted as true (T).

If the signature is part of a family ('family_cut' is defined) and if the domain E-value is worse than the domain cut off ('cutoff') then the match is dropped. If the signature has "siblings" (because it has a family_cut defined), and they overlap, the preferred sibling is chosen as the true match according to information in the overlaps file.

PROSITEpatterns CONFIRNation: ScanRegExp is able to verify PROSITE matches using corresponding statistically-significant CONFIRM patterns. The default status of the PROSITE matches is unknown (?) and the true positive (T) status is assigned if the corresponding CONFIRM patterns match as well. The CONFIRM patterns were generated based on the true positive SWISS-PROT PROSITE matches using eMOTIF software with a stringency of $10e^{-9}$ P-value.

PANTHER filtering: Panther has pre- and post-processing steps. The preprocessing step is intended to speed up the HMM-based Searching of the sequence and involves blasting the HMM sequences with the query protein sequence in order to find the most similar models above a given e-value. The resulting HMM hits are then used in the HMM-based search.

Panther consists of families and sub-families. When a sequence is found to match a family in the blast run, the sub-families are also scored using HMMER tool (that is, unless there is only 1 sub-family, in which case, the family alone is scored against). Any matches that score below the e-value cut-off are discarded. Any remaining matches are searched to find the HMM with the best score and e-value and the best hit is then reported (including any sub-family hit).

GENE3D filtering: Gene3D also employs post-processing of results by using a program called DomainFinder. This program takes the output from searching the Gene3D HMMs against the query sequence and extracts all hits that are more than 10 residues long and have an e-value better than 0.001. If hits overlap at all, the match with the better e-value is chosen.

The polypeptides of the invention the expression of which confers and/or enhances the resistance of a plant to *M. fijiensis* can be characterized by specific amino acid domains. According to certain embodiments, particular domains are conserved within a family of polypeptides as described in Table 5 hereinbelow. Without wishing to be bound by specific theory or mechanism of action, the conserved domain may indicate common functionally of the polypeptides comprising same. The domains are presented by an identifier (number). Table 6 provides the details of each domain.

TABLE 5

Core and homologous polypeptides comprising the same domains

| Core Peptide (SEQ ID NO) | Characteristic Domains (Domain identifier) | Homologous Polypeptides Comprising the Domains (SEQ ID NOs) |
|---|---|---|
| 160 | 4; 3; 1; 2; 1; 1; 1; 1; 1 | |
| 161 | 5; 5; 5 | 192 |
| 162 | 6 | 193; 194 |
| 163 | 10; 13; 11; 13; 13; 14; 11; 11; 11; 13; 11; 13; 11; 12; 13; 11; 13; 11; 11 | 195 |
| 164 | 18; 15; 17; 17; 18; 16 | 196; 197; 251; 252; 253; 254; 255 |
| 165 | 20; 20; 20; 19; 19; 19; 19 | 198 |
| 166 | 22; 23; 22; 21; 21; 22; 21; 23; 21 | 199 |
| 167 | 29; 25; 26; 26; 26; 27; 27; 24; 28; 28; 28 | 200; 201; 202; 203; 204; 205; 206; 207; 208; 209; 210; 211 |
| 168 | 31; 30 | 212; 213; 214; 215 |
| 169 | 33; 33; 33; 33; 22; 22; 32 | 169; 256; 257 |
| 170 | 3; 34; 35; 35; 35; 37; 35; 35; 35; 35; 35; 36 | 216; 217; 218 |
| 171 | | |
| 172 | 4; 3; 1; 2; 1; 1; 1; 1; 1 | 219; 220; 258 |
| 173 | 39; 38; 39; 39; 39 | 221; 259 |

TABLE 5-continued

Core and homologous polypeptides comprising the same domains

| Core Peptide (SEQ ID NO) | Characteristic Domains (Domain identifier) | Homologous Polypeptides Comprising the Domains (SEQ ID NOs) |
|---|---|---|
| 174 | 3; 4; 41; 40; 40; 40; 40 | 222; 223; 260 |
| 175 | 42; 44; 44 | 224; 225; 226; 227; 228; 229; 230; 231; 232; 233; 234 |
| 176 | 45 | 176; 235; 236 |
| 177 | 46; 46; 46; 47; 46; 47; 46; 46; 47; 48; 49 | 177; 237; 238; 239; 240; 241; 242; 243; 244; 245; 246; 247; 248; 249; 250 |
| 261 | 9; 7; 8 | 262 |

TABLE 6

Details of Identified Domains

| Domain Identifier | InterPro No. | Accession No. | Description |
|---|---|---|---|
| 1 | IPR001360 | PR00131 | Glycosyl hydrolase family 1 signature Glycoside hydrolase family 1 |
| 2 | IPR033132 | PS00653 | Glycosyl hydrolases family 1 N-terminal signature. Glycosyl hydrolases family 1, N-terminal conserved site |
| 3 | IPR017853 | SSF51445 | Glycoside hydrolase superfamily |
| 4 | IPR013781 | G3DSA: 3.20.20.80 | Glycoside hydrolase, catalytic domain |
| 5 | IPR003441 | PS51005 | NAC domain profile. NAC domain |
| 6 | IPR004864 | PF03168 | Late embryogenesis abundant protein Late embryogenesis abundant protein, LEA-14 |
| 7 | IPR000719 | PS50011 | Protein kinase domain profile. Protein kinase domain |
| 8 | IPR008271 | PS00108 | Serine/Threonine protein kinases active-site signature. Serine/threonine-protein kinase, active site |
| 9 | IPR011009 | SSF56112 | Protein kinase-like domain |
| 10 | IPR010255 | SSF48113 | Heme peroxidase |
| 11 | IPR000823 | PR00461 | Plant peroxidase signature Plant peroxidase |
| 12 | IPR019793 | PS00435 | Peroxidases proximal heme-ligand signature. Peroxidases heme-ligand binding site |
| 13 | IPR002016 | PF00141 | Peroxidase Heme peroxidase, plant/fungal/bacterial |
| 14 | IPR019794 | PS00436 | Peroxidases active site signature. Peroxidase, active site |
| 15 | IPR016455 | PIRSF005604 | Xyloglucan endotransglucosylase/hydrolase |
| 16 | IPR010713 | PF06955 | Xyloglucan endo-transglycosylase (XET) C-terminus Xyloglucan endo-transglycosylase, C-terminal |
| 17 | IPR013320 | G3DSA: 2.60.120.200 | Concanavalin A-like lectin/glucanase domain |
| 18 | IPR000757 | PS51762 | Glycosyl hydrolases family 16 (GH16) domain profile. Glycoside hydrolase family 16 |
| 19 | IPR000058 | SM00154 | Zinc finger, AN1-type |
| 20 | IPR002653 | PF01754 | A20-like zinc finger Zinc finger, A20-type |
| 21 | IPR001005 | PF00249 | Myb-like DNA-binding domain SANT/Myb domain |
| 22 | IPR009057 | G3DSA: 1.10.10.60 | Homeodomain-like |
| 23 | IPR017930 | PS51294 | Myb-type HTH DNA-binding domain profile. Myb domain |
| 24 | IPR003593 | SM00382 | AAA + ATPase domain |
| 25 | IPR007222 | PF04086 | Signal recognition particle, alpha subunit, N-terminal Signal recognition particle receptor, alpha subunit, N-terminal |
| 26 | IPR013822 | SM00963 | Signal recognition particle, SRP54 subunit, helical bundle |
| 27 | IPR027417 | SSF52540 | P-loop containing nucleoside triphosphate hydrolase |
| 28 | IPR000897 | PF00448 | SRP54-type protein, GTPase domain Signal recognition particle, SRP54 subunit, GTPase domain |
| 29 | IPR011012 | SSF64356 | Longin-like domain |

TABLE 6-continued

Details of Identified Domains

| Domain Identifier | InterPro No. | Accession No. | Description |
|---|---|---|---|
| 30 | IPR026057 | PF13839 | GDSL/SGNH-like Acyl-Esterase family found in Pmr5 and Cas1p PC-Esterase |
| 31 | IPR025846 | PF14416 | PMR5 N terminal Domain PMR5 N-terminal domain |
| 32 | IPR006455 | TIGR01565 | homeo_ZF_HD: homeobox domain, ZF-HD class Homeodomain, ZF-HD class |
| 33 | IPR006456 | PF04770 | ZF-HD protein dimerisation region ZF-HD homeobox protein, Cys/His-rich dimerisation domain |
| 34 | IPR013785 | G3DSA: 3.20.20.70 | Aldolase-type TIM barrel |
| 35 | IPR002241 | PF16499 | Alpha galactosidase A Glycoside hydrolase, family 27 |
| 36 | IPR013780 | G3DSA: 2.60.40.1180 | Glycosyl hydrolase, all-beta |
| 37 | IPR000111 | PS00512 | Alpha-galactosidase signature. Glycoside hydrolase family 27/36, conserved site |
| 38 | IPR001087 | PF00657 | GDSL-like Lipase/Acylhydrolase GDSL lipase/esterase |
| 39 | IPR013830 | G3DSA: 3.40.50.1110 | SGNH hydrolase-type esterase domain |
| 40 | IPR012946 | PF07983 | X8 domain X8 domain |
| 41 | IPR000490 | PF00332 | Glycosyl hydrolases family 17 Glycoside hydrolase family 17 |
| 42 | IPR013210 | PF08263 | Leucine rich repeat N-terminal domain Leucine-rich repeat-containing N-terminal, plant-type |
| 43 | IPR001611 | PF13855 | Leucine rich repeat Leucine-rich repeat |
| 44 | IPR032675 | G3DSA: 3.80.10.10 | Leucine-rich repeat domain, L domain-like |
| 45 | IPR000877 | SM00269 | Proteinase inhibitor I12, Bowman-Birk |
| 46 | IPR000209 | PF00082 | Subtilase family Peptidase S8/S53 domain |
| 47 | IPR015500 | PR00723 | Subtilisin serine protease family (S8) signature Peptidase S8, subtilisin-related |
| 48 | IPR023828 | PS00138 | Serine proteases, subtilase family, serine active site. Peptidase S8, subtilisin, Ser-active site |
| 49 | IPR022229 | PF12580 | Tripeptidyl peptidase II Peptidase S8A, tripeptidyl peptidase II |

Example 5: Gene Cloning and Expression in Banana Plants

To validate the role of genes identified hereinabove in increasing resistance to fungal infection, selected genes were over-expressed in plants, as follows.

Cloning Strategy

Several genes identified to be associated with resistance to *Mycosphaerella fijiensis* as detailed in Table 7 hereinbelow were cloned into binary vector(s) for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from leaves affected by black sigatoka. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York) which are well known to those skilled in the art. PCR products were purified using PCR purification kit (Qiagen).

Typically, 2 sets of primers were prepared for the amplification of each gene, via nested PCR (if required). Both sets of primers were used for amplification on a cDNA. In case no product was obtained, a nested PCR reaction was performed. Nested PCR was performed by amplification of the gene using external primers and then using the produced PCR product as a template for a second PCR reaction, where the internal set of primers was used. Alternatively, one or two of the internal primers were used for gene amplification, both in the first and the second PCR reactions (meaning only 2-3 primers are designed for a gene). To facilitate further cloning of the cDNAs, an 8-12 base pairs (bp) extension was added to the 5' of each internal primer. The primer extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc.) according to the sites designed in the primers. Each digested/undigested PCR product was inserted into pGEM®-T Easy Vector System (Promega). The digested/undigested products and the linearized plasmid vector were ligated using T4 DNA ligase enzyme (Roche, Switzerland or other manufacturers). Sequencing of the inserted genes was performed using the ABI 377 sequencer (Applied Biosystems).

The selected genes were inserted into a modified pBIN binary vector (FIG. 1).

Table 7 hereinbelow provides a list of the gene cloned, including gene name, the organism from which the gene is derived, and the SEQ ID NO. of the gene polynucleotide and encoded polypeptide.

TABLE 7

| | | Cloned genes | | |
|---|---|---|---|---|
| Gene Name | Organism | Polyn. SEQ ID NO: | Polyp. SEQ ID NO: | Primer SEQ ID NO: |
| BAN3 | Musa acuminata | 61 | 178 | 283, 284 |
| BAN5 | Musa acuminata | 62 | 179 | 300, 301 |
| BAN6 | Musa acuminata | 63 | 180 | 267, 268 |
| BAN7 | Musa acuminata | 157 | 261 | 302, 303 |
| BAN8 | Musa acuminata | 64 | 181 | 304 |
| BAN11 | Musa acuminata | 65 | 182 | 269, 270, 271 |
| BAN12 | Musa acuminata | 66 | 183 | 272 |
| BAN18 | Musa acuminata | 67 | 184 | 273, 274 |
| BAN22 | Musa acuminata | 68 | 185 | 275, 276, 277, 278 |
| BAN24 | Musa acuminata | 69 | 186 | 279, 280 |
| BAN26 | Musa acuminata | 70 | 187 | 263, 264 |
| BAN29 | Musa acuminata | 71 | 188 | 281, 282 |
| BAN34 | Musa acuminata | 72 | 171 | 265, 266 |
| BAN36 | Musa acuminata | 73 | 189 | 285, 286 |
| BAN41 | Zea mays | 74 | 190 | 287, 288 |
| BAN43 | Triticum aestivum | 75 | 191 | 289, 290 |
| BAN44 | Triticum aestivum | 76 | 175 | 291, 292, 293 |
| BAN46 | Triticum aestivum | 77 | 176 | 294, 295, 296, 297 |
| BAN47 | Oryza sativa | 78 | 177 | 298, 299 |

"polyn." = polynucleotide; "polyp." = polypeptide.

Example 6: Transformation of Banana Plants with the Polynucleotides of the Invention Selection of Mother Plants Pre-selected Banana plants (*Musa Acuminata* AAA Cavendish subgroup Grand Name) were grown in a commercial plantation in the Western Galilee Israel. Immediately after flower shooting, the male part of the flower was harvested and immediately used to produce an embryogenic cell suspension as described by Escalant et al. (Escalant J V, et al. 1994. In Vitro Cell Dev. Biol. Plant, 30:181-186).

Transformation of Cell Culture

*Agrobacterium tumefaciens*, strain AHA 105 was cultured on 2YT medium supplemented with 200 mg $L^{-1}$ Kanamycin for 48 hours at 27-29° C. The cells were suspended in bacterial resuspension medium (see description of media hereinbelow) and diluted to OD 0.6 at 600 nm. The cells were subsequently cultured for 3 hours at room temperature for pre-induction.

An aliquot of 1 mL of the packed banana cells was left for 1 hr after sub-culturing at room temperature and subsequently sieved through 400 µm nylon mesh. A 0.1 mL aliquot of the sediment cell volume (SCV) was re-suspended in 0.5 mL fresh cell suspension (CS) culture medium in a 2 mL sterile Eppendorf tubes. The cells were incubated for 5 minutes at 45° C. before 0.8 mL of the pre-induced bacterial culture was added. The combined cultures were centrifuged for 5 minutes at 1000 rpm at R.T. and then incubated for 25 minutes at room temperature.

The bacterial cells were removed from the top and the sediment comprising the plant cells was re-suspended in a fresh CS culture medium. The cells were transferred onto a sterile glass microfiber filter placed in a Petri dish (55 mm) containing a co-cultivation medium. The cells were kept in the dark at RT for 3 days. After 3 days nylon filter disc with cells was placed onto post-infection recovery medium for 7-10 days in the dark and then transferred onto a solid selection medium and sub-cultured at 4-week intervals at least twice, until embryos started to appear.

The proliferated cells and small embryos were transferred onto an embryo maturation medium containing a selection agent (50 mg $L^{-1}$ G418) for one month. The somatic embryos were transferred onto a germination medium containing the selection agent. The germinated plantlets were transferred onto a rooting medium containing the selection agent.

Culture Media

Bacterial Resuspension Medium $^1/_{10}$ MS; 9 mg $L^{-1}$ Thiamine, 0.4 mg $L^{-1}$ cysteine, 3.6% glucose, 100 µM Acetosyrengone (filter sterilized). The pH was adjusted to 5.2

Cell Suspension (CS) Culture Medium

½ MS macro and micro elements, MS FeNaEDTA, 0.4 mg $L^{-1}$ Thiamine, 0.5 mg $L^{-1}$ Nicotinic acid, 0.5 mg $L^{-1}$ Pyridoxine, 2.0 mg $L^{-1}$ *Glycine*

10 mg $L^{-1}$ Ascorbic acid, 1.1 mg $L^{-1}$ 2,4-D, 0.2 mg $L^{-1}$ Zeatin, 3% sucrose.

Before autoclaving the pH was adjusted to 6.2

Co-Cultivation Medium

The CS culture medium was solidified with 0.25% gelrite (Duchefa) and supplemented with 100 µM Acetosyrengone.

Post-Infection Recovery Medium

The CS culture medium was solidified with 0.25% gelrite (Duchefa) that was supplemented with 300 mg $L^{-1}$ Cefotaxime.

Selection Medium

The CS culture medium was solidified with 0.25% gelrite supplemented with 300 mg $L^{-1}$ Cefotaxime and 50 mg $L^{-1}$ and 50 mg $L^{-1}$ G418.

Embryos Maturation Selective Medium

SH macro and micro elements; MS vitamins, 100 mg $L^{-1}$ glutamine, 100 mg $L^{-1}$ malt extract, 1 mg $L^{-1}$ biotin, 230 mg $L^{-1}$ proline, 0.05 mg $L^{-1}$ zeatin, 0.1 mg $L^{-1}$ kinetin, 0.2 mg $L^{-1}$ NAA, 0.2 mg $L^{-1}$ 2iP, 4.5% sucrose, 1% lactose, 6.5 mg $L^{-1}$ agar (Duchefa), 300 mg $L^{-1}$ Cefotaxime, 50 mg $L^{-1}$ G418. The pH was adjusted to 5.8.

Selective Germination Medium

MS macro and micro elements (including FeNaEDTA), MS vitamins, 0.02 mg $L^{-1}$ NAA, 2 mg $L^{-1}$ kinetin, 3% sucrose, 6.5 mg $L^{-1}$ (Duchefa), 50 mg $L^{-1}$ G418. The pH was adjusted to 5.8 Selective rooting medium MS macro and micro elements (including FeNaEDTA), MS vitamins, 0.02 mg L$^{-1}$ NAA, 3% sucrose, 6.5 mg L$^{-1}$ agar (Duchefa), 100 mg L$^{-1}$ Kanamycin. The pH was adjusted to 5.8.

Example 7: Validation Assay—Field Trial

Transgenic plants prepared from embryonic cell lines as described in the previous section were hardened in commercial hardening lath houses under tropical climate conditions. The hardening process duration was 6 weeks. The hardening procedure was performed in plastic trays (104 plants per tray) in a volume of 10 cc soil per plant. The soil substrate contained a mix of peatmos:perlite (60:40) and the plants were irrigated and fertilized according to common commercial practices.

After hardening the plants were transferred to 5 L plastic bags (one plant per bag), filled with a medium containing peatmoss:sand:rice husks (40:40:20) under 30% shade. Six weeks later the plants were planted in a commercial plantation site under extensive disease pressure.

$$BSI = \frac{100*(YLS - 1)}{NSL}$$

Wherein:

YLS=Youngest leaf spotted

NSL=Number of standing leaves, counting from the youngest (i.e. the highest and unrolled) leaf downward.

Statistical Analyses

BSI values of transgenic banana plants, each representing a separate gene event, were analyzed according to the Poisson distribution (Papoulis, A. "Poisson Process and Shot Noise." Ch. 16 in Probability, Random Variables, and Stochastic Processes, 2nd ed. New York: McGraw-Hill, pp. 554-576, 1984). The p value represents the chance to see the maximum value (BSI) of the gene in the control Poisson distribution (significant p value Poisson distance <0.05).

Table 8 shows genes significantly improving resistance to M. fijiensis (Poisson distribution analysis).

TABLE 8

First trial-Validation results upon natural infection with M. fijiensis

| Weekly Fumigation | | Fumigation every 2 weeks | | Fumigation every 3 weeks | | No fumigation | |
|---|---|---|---|---|---|---|---|
| Gene | P value | Gene | P value | Gene | P value | Gene | P value |
| BAN3 | 0.04589 | BAN7 | 0.0387 | BAN3 | 9.38E−05 | BAN3 | 0.0396 |
| BAN11 | 0.04635 | BAN11 | 0.0387 | BAN6 | 0.0113 | BAN7 | 0.0396 |
| BAN12 | 0.04635 | BAN36 | 0.0121 | BAN7 | 0.0454 | BAN34 | 0.0087 |
| BAN34 | 0.04589 | BAN44 | 0.0387 | BAN8 | 0.0113 | BAN44 | 0.0126 |
| BAN36 | 0.04589 | BAN46 | 0.0387 | BAN11 | 0.0113 | BAN46 | 0.0126 |
| BAN41 | 0.04589 | BAN47 | 0.0121 | BAN12 | 0.0454 | | |
| BAN46 | 0.04589 | | | BAN36 | 0.0113 | | |
| | | | | BAN41 | 0.0454 | | |
| | | | | BAN44 | 0.0454 | | |
| | | | | BAN46 | 0.0014 | | |
| | | | | BAN47 | 0.0454 | | |

For each gene, a different number of events (each event=one plant) was tested according to the number of regenerated plants available at the time of the field trial. As used herein, the term "event" refers to a single transgenic plant regenerated from an embryo transformed with a single gene. Five to 10 available events per gene per fumigation treatment were examined.

During the first field trial three fumigation treatments (once a week; every 2 weeks and every 3 weeks) were performed. Strobilurines fungicides (Azoxystrobin—BANKIT Syngenta) were applied at 250 g/l and 0.4l/ha.

No fumigation was applied during the second validation trial.

Spacing was in a single row, at 3.5 m×3.5 m. Control, untransformed Grand Name banana plants were planted at a frequency of every 5 plants in the row. Indexing for the disease was performed at anthesis as described hereinbelow.

Black Sigatoka Indexing

The proportion of standing leaves without the typical late-stage symptoms of black Sigatoka, that is a black spot with a necrotic center, was used as a disease index. This index provides an estimation of available photosynthetic leaf area prior to fruit filling and is a measure of Sigatoka resistance in banana (Musa spp. L). Calculation of Black Sigatoka Index (BSI) was performed according to Ortiz (Ortiz, R. 1997. Theor. Appl. Genet. 94, 1113-1120) as follows:

In a second trail, no fumigation was applied; 10 to 80 available plants (events) per gene were examined. Genes significantly improving resistance to M. fijiensis by Poisson distribution analysis are presented in Table 9.

TABLE 9

Second trial - validation results upon natural infection with M. fijiensis

| Gene Name | P value |
|---|---|
| BAN3 | 0.021232 |
| BAN7 | 0.00372 |
| BAN8 | 0.00372 |
| BAN11 | 0.021232 |
| BAN18 | 0.00372 |
| BAN24 | 0.0212 |
| BAN29 | 0.0212 |
| BAN34 | 0.00372 |
| BAN36 | 0.003 |
| BAN43 | 0.0212 |
| BAN44 | 0.00034 |
| BAN46 | 0.00372 |

Analysis of the BSI value according to the Poisson distribution in both trials revealed that the genes BAN3, BAN7, BAN8, BAN11, BAN34, BAN36, BAN44 and BAN46 significantly increased the resistance of the transgenic plants to *M. fijiensis* compared to the resistance observed in non-transgenic control.

Example 8: Overexpression of a Polypeptide by Renome Editing

Over-expression of a polypeptide according to certain embodiments of the present invention can be achieved using methods of gene editing. One example of such approach includes editing a selected genomic region as to express the polypeptide of interest. In the current example, the target genomic region (based on genome version GenBank assembly accession—GCA_000313855.1) and the polypeptide to be over-expressed is the banana BAN8 comprising the amino acid sequence set forth in SEQ ID NO:163 encoded by the polynucleotide having the nucleic acid sequence set forth in SEQ ID NO:46. It is to be explicitly understood that other genome loci can be used as targets for genome editing for over-expressing other polypeptides of the invention based on the same principles.

FIG. 2A depicts the sequence of the endogenous 5' upstream flanking region of the genomic sequence of the gene (SEQ ID NO:308) and FIG. 2B depicts the sequence of the endogenous 3'-downstream flanking region of this genomic locus (SEQ ID NO:309). FIG. 2C depicts the sequence of the 5'-UTR gRNA (SEQ ID NO:306) and FIG. 2D depicts the sequence of the 5'-UTR gRNA without NGG nucleotides following the 3 nucleotides after the Cas9 cutting (SEQ ID NO:310). FIG. 2E depicts the sequence of the 3'-UTR gRNA (SEQ ID NO:307) and FIG. 2F depicts the sequence of the 3'-UTRgRNA after cut (SEQ ID NO:311). FIG. 2G depicts the coding sequence (from the "ATG" start codon to the "TAG" termination codon, marked by bold and underlined) of the desired BAN8 sequence (SEQ ID NO:313) encoding the polypeptide set forth by SEQ ID NO:46.

The complete exemplary repair template (SEQ ID NO:312) is depicted in FIG. 2H. The repair template includes: (1) the upstream flanking region (1 kbp) sequence including part of the gRNA after cutting (SEQ ID NO:310; shown in bold and italics); (2) 5' UTR of genomic DNA from Cas9 cutting site to ATG; (3) the coding sequence (CDS) of the desired BAN8 sequence (SEQ ID NO:313) with the start (ATG) and the stop (e) codons marked in bold and underlined; (4) 3' UTR of genomic DNA from the stop codon to Cas9 cutting site including the predicted part of the gRNA after cutting (SEQ ID NO:311), shown in bold and italics and (5) the downstream flanking region (1 kbp) sequence.

The repair template is delivered into the cell type of interest along with the 5' and 3'guide RNA sequences (SEQ ID NO:306 and SEQ ID NO:307, respectively).

Example 9: Knock Out of a Polypeptide by Renome Editing

Knock-out of a polypeptide according to certain embodiments of the present invention can be achieved using methods of gene editing.

In the current example, the target genomic region is the "banana" BAN29 comprising the amino acid sequence set forth in SEQ ID NO:170 encoded by the polynucleotide having the nucleic acid sequence set forth in SEQ ID NO:53. It is to be explicitly understood that other genome loci can be used as targets for genome editing for over-expressing other polypeptides of the invention based on the same principles.

The Crisper/CAS9 or similar systems can generate double stranded breaks (DSBs) at any genomic locus under the guidance of an engineered single-guide RNA when delivered into the cell type of interest. Non-homologous end-joining (NHEJ) in the absence of DNA template accompanied with the modification of target genomic repair the DSBs but tends to be prone to insertion and/or deletion (indel) mutations at the junctional site therefore causing frame-shifts mutations that disrupt the targeted gene (FIG. 3)

FIG. 3A depicts the sequence of the KO gRNA (SEQ ID NO:314); FIG. 3C depicts the coding sequence (from the "ATG" start codon to the "TAG" termination codon, marked by bold and underlined) of the desired BAN29 sequence (SEQ ID NO:316); FIG. 3B depicts the sequence of the KO gRNA after cut (SEQ ID NO:315); FIG. 3D depict the coding sequence of the KO anticipated change (SEQ ID NO:317)

The foregoing description of the specific embodiments will so fully reveal the general nature of the invention that others can, by applying current knowledge, readily modify and/or adapt for various applications such specific embodiments without undue experimentation and without departing from the generic concept, and, therefore, such adaptations and modifications should and are intended to be comprehended within the meaning and range of equivalents of the disclosed embodiments. It is to be understood that the phraseology or terminology employed herein is for the purpose of description and not of limitation. The means, materials, and steps for carrying out various disclosed functions may take a variety of alternative forms without departing from the invention.

SEQUENCE LISTING (317 sequences)

SEQ ID NO: 1 - DNA, 2000 bp, Wheat
  Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 2 - DNA, 1919 bp, Wheat
  misc_feature (1306)..(1316): n is a, c, g, or t
  misc_feature (1649)..(1649): n is a, c, g, or t
  Wheat LMW Longer Promoter
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 3 - DNA, 326 bp, Wheat
  misc_feature (56)..(56): n is a, c, g, or t
  Wheat LMW Promoter
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 4 - DNA, 2000 bp, Wheat
  Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 5 - DNA, 425 bp, Wheat
  Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 6 - DNA, 595 bp, Wheat
  wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 7 - DNA, 1238 bp, Wheat
  misc_feature (1231)..(1231): n is a, c, g, or t
  wheat gamma gliadin Promoter
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 8 - DNA, 2162 bp, Wheat
  wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 9 - DNA, 2147 bp, Wheat
  wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 10 - DNA, 1992 bp, Maize
  maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 11 - DNA, 1358 bp, Maize
  Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 12 - DNA, 1266 bp, Rice
  rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 13 - DNA, 2199 bp, Rice
  rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 14 - DNA, 1024 bp, Rice
  rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 15 - DNA, 2103 bp, Arabidopsis
  arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 16 - DNA, 901 bp, Rice
  rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 17 - DNA, 844 bp, Rice
  rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 18 - DNA, 602 bp, Barley
  barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 19 - DNA, 1729 bp, Barley
  Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 20 - DNA, 879 bp, Rice
  rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 21 - DNA, 666 bp, Cauliflower mosaic virus
  CaMV 35S (pQXNc) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 22 - DNA, 781 bp, Brachypodium
  PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 23 - DNA, 877 bp, Cauliflower mosaic virus
  CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 24 - DNA, 2322 bp, Arabidopsis
  Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 25 - DNA, 2318 bp, Arabidopsis
  Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 26 - DNA, 1321 bp, Brachypodium
  RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 27 - DNA, 1599 bp, Arabidopsis
  Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 28 - DNA, 1774 bp, Arabidopsis
  Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 29 - DNA, 1127 bp, Canola
  Brassica napus NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 30 - DNA, 916 bp, Arabidopsis
  Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 31 - DNA, 3965 bp, Arabidopsis
  Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 32 - DNA, 4074 bp, Arabidopsis
  Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 33 - DNA, 1700 bp, Arabidopsis
  Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 34 - DNA, 1096 bp, Arabidopsis
  RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 35 - DNA, 2432 bp, Arabidopsis
  arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 36 - DNA, 277 bp, Agrobacterium tumefaciens
  NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 37 - DNA, 538 bp, Cauliflower mosaic virus
  35S pEBbVNi Promoter
catggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggact

SEQ ID NO: 38 - DNA, 555 bp, Streptomyces hygroscopicus
  Streptomyces hygroscopicus (A10) Bar Gene
atgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatctgatga

SEQ ID NO: 39 - DNA, 562 bp, Artificial Sequence
  BAR_GA
agcagccatgagcccagagaggcgcccagccgatatcagaagggctacagaggccgatatgccggccgtgtgcaccatcgtgaaccactacatcgagacatccaccgtgaacttcaggaccgagccgcaagagccacaagagtggaccgatgatctcgtgaggctccgcgagagatacccatggctcgtggctgaagtggatggcgaggttgccggcattgcttatgctggcccatggaaggctaggaacgcctacgattggaccgccgagtccacagtgtacgtgtccccaaggcatcagagaaccggcctcggctctaccctctacacccatctgctcaagtcccttgaggcccaaggcttcaagtctgtggtggctgttatcggcctcccgaacgatccatccgtgaggatgcatgaggctctcggctatgccccaaggggaatgctcagagctgctggcttcaagcacggcaactggcacgatgtgggcttttggcagctcgacttcagcctcccagttccgccaagaccagtgctcccagtgaccgagatctgatga

SEQ ID NO: 40 - protein, 72 aa, Arabidopsis
  RUBISCO small subunit protein
MASSMLSSAAVVTSPAQATMVAPFTGLKSSAAFPVTRKTNKDITSIASNGGRVSCMKVWPPIGKKKFETLSY

SEQ ID NO: 41 - DNA, 216 bp, Arabidopsis
  RUBISCO small subunit nucleotide
atggcttcctctatgctctcctccgccgctgtggttacatccccggctcaggccaccatggtcgctccattcaccggcttgaagtcatccgctgcattcccggtcacccgcaagaccaacaaggacatcacttccatcgcaagcaacgggggaagagttagctgcatgaaggtgtggccaccaattggaaagaagaagtttgagactctatcttac

SEQ ID NO: 42 - DNA, 554 bp, Soybean
  TVSP Terminator
ctcaacaatctagctagagtttgctcctatctatatgtaataaggtatgctgatatgcactattcaaataggagcattagctatgtttgttaatgtcactttatgttatgtgggtaagtcacctaagacactccacgtacctacttgttgtctcttacgcggctttaataaatcttctgcccttgttccatatttactaattatccctttcttcactaaaagaaaattgttatcattaagtattagtctttagaacatatgaggtctttaattgggtaggttttacaaattaactaatataaaatgtcataaaatccacgtggttaaacaaatgcagaaaatcgacgtcgtctattggaccgacagttgctattaatataatgggccaccatagtagactgacaaataaattacctgacaacatcgtttcacaaaaaaacaaacacaaaaagggagtgcattttccagggcatttttgtaataaaaaacagttaaaagggagtgcaatagaaatataggggtgtggaaatagtgatttgagcacgtcttgaagc

SEQ ID NO: 43 - DNA, 1926 bp, Musa acuminata
cactgcacgactacttgcgcggctttgaccgcttcctcctcctcctcctcaccttcgtgctctctggagactcgagcgagaggagatgagggaagggagaccagcctggttgctaatcctaggagtggtactcctgctgtttttgtcttcgttagcagagggttcggggcagctgacggagcccagcttcagcagagctgacttccctttagacttcgacttcggagctgggacgtcgtcttatcaggtggagggagcagtatctgaggatggaaggaaaccaagcatttgggatacctttactcatgcagggcgaatgctggacaagagcacaggagatgtggcttctgatggctaccacaaatacaaggaagatgtcaagctgatggctgaaacaggactggactcctacagattctccatctcttggtccaggcttatcccaaatggtagaggagctgttaatcctaaaggcttacagttttacaacaacctgattgatgagctagtaaaatatggaatcaaacctcatgtgtcactataccatcttgaccatccccaagcacttgaagataagtattcaggatggttgagtcccaaaatggtggatgatttcacagcatttgcagatgtatgtttcaagaattttggtgacagagttcctcgatggacgactattgtcgaacctaatataatgtcactgggtgcatatgacatgggaacacttccaccaaatcggtgctcttatccatttggcatcaattgcacagtaggaaattcaacgacagagccctacattgcgattcacaatgtcctattagcccatgcatcgatcgtcaaattatacaaaagcaaatatcaagcagagcaaaatgggtggataggcattaatgtctacactttctggtattatccattcacaaactcttctgcagacattgaggcaacccaaagaatacttgagttttatgttggctggatcctaaatccattggtgtttggagactatcctgaggtcatgaagaagttcgtcggctcgcgactcccatccttcaccaaatctcagtctgaacaaataaagggcttatttgatttcattggcgtgaatcactattcttcaatatatgtcaaagataacatcaatgcttctgagatgggtcttcgcgactttgttatggattccttagccttggtgacaacttcaagaaatgagacacctggtcagtatgaccctacggcaccttcatcattcgatcctcaggggctgcaatacatgttggagtatctcagagatgcctacggaaatcctcctctttttgttgaagaaaatggctatggcataggaaggagagagagcgacgaccttaatgacaccgataggatcaattacctgaatggcttcatcggtagcatgctcgatgctatcaggaatggagcgaatgtgaaaggttacttcgtttggtcgttcatagatgtcttcgagtttttgactgggtatcaatctcgttgcggattgtaccatgtggattttgatgatgagaaccgtaaaagaaagccgaagctctctgccatttggtactctaagcttcttgaaagaaaggatggcatgaaactgaacaaaactgcaatggatacagaataccatgctcggtggtaacattcctccgcacaattcctgtgttaaatagatttagatcacacgagtcagttttctcgtcttgagcaaatacaggcactcgaattagctcaataaaaaatgggatctaaaactggtaggactgtgaaaataaagtggtctactccttcatattaagtgtttttgtatgagttcaagcatgtagttcaaaagttcctgcagtggtttgagttatatttcacctcatccacctgaactggagaattgttattggacgatctataatgcag

SEQ ID NO: 44 - DNA, 2250 bp, Musa acuminata
acccacagggtcaagggcggcgcactgatctacgctttgatagagctccccaggcggttctgcttgcatatcaaatgtcttttgacatcagaacggactatcctagttttctttggtgcgactttcggttcatatgccgtagtctgttgttttgttgtcgtagagcattatttcggcactggacttgataattcagagattttggctcggagctgaacttaatccaaaggtttccatttccgagcccacaaaggttttcgctgctgaggatacttttgagaagcacagttatactgttattgctgtttggctagatcaaattttaagtctcattatagtattatagacaagagatcgtgatggctaagaccaacctcccaccgggcttccgttttcaccccactgatgttgagcttgtttggtactacttgaagaggaaagtaatgggaaagcctttccggtctgaggctatttctgaagttgagctatacaaattcgccccttgggaactcccagaaaaatctcggttgcgcacaagggatcttgagtggtacttcttttgccatcgtgataaaaaatattcaaatggctctcgatcaaatcgagcaactgatggtggttattggaaggctactggaaaagacaaatctgtcattcacaactcttgtacggttggtatgagaaggactctagtttttcacgaggggaaaccaccaaaggggacaaggactaactgggtgatgtatgagtaccgactagagagcagggaattggttgatgctggattcgcacaggacgcttacttactctgcaaagtattccaaaagagtggtctgggtcctagaattggggagcaatatggtgcgccatttaacgaagaggactgggaggatgacacggctattgagagttcctttcctcttccttgtgtatcttcttgcctgagtgcagaaccattagataaccaagctatacaggcggatccagttagcaaacagcctatagcttccagtgctgttgagttactttccgatcatgatcttcttgatgttgatggaatattgctggaggagttggcagagtttcttaatagctctccactcgtagagaatgctaatggcaagatgcctgatttaaccattcctagcatgaatgttaatgaagctgcagctatggaccctgaaggagtatataatgaattagacgatctctctactggggaattgatttctggcaatatcgatctaattgaaaacattctcaatgaaactgccttgtgtcctacgctacaagaacttgatagtaaacagtatgttgagctgaatgatcttattggggatggaaatccctatgtgtctgtcgagccaagtactccatttgccccaaacccatctggtcattggcccgatttggagaatctgaatcacatccttgatccaatcccttactttgataatgatgtttatggtggtatgcgtggtcttcctcatacaggacctgatacaacaagccaacattggtcaccgggcatgcagattggagattttggtgaatttgtgcccccacttgaacgatcctctttctgagtatttatcatcacttgcaagaacactctccagctaaattcctgtggccccttttgtctatatgggtttcaagcatcaaaagccaagtgtttgttatagctatgggccaatatttactgaaaggacgatgtcaagaaaagaaaatggattcacactacttgtgagttctgccttagaagagatgctcatcagtaaattttgcagcgcttccctgatttgttttggttcttcaaccaaagtacaacttatttcttactagtgtctctctctggaatctggtggaagttgaaacactgcaatttatttcgtggtatctatttcggtgttcaccagatttaccaaaagtgagcgtcactcagagcttctcatggctatagacaacacagcttctcatggggtattaccactttgcaccaaaagctgacattcaaacttcatgagggacggttgtctgccttcagcagcatttatttcagcatggatgttaatgggaagtcgcatgctacatctattttatgtccttattcgatgtttaatgatgtaacgcttggcaaagggagggggccaataattatagtgctggtttgtgtcctgaactgctacttgataataaaagacgtctattgtagaacatttaagtcgacacttttgtcttcttggtgat

SEQ ID NO: 45 - DNA, 939 bp, Musa acuminata
cgaaccttccttgtctcctccattgacatttctactgcgttcatccctcaatttgcgtgtggttttgaaggagatgtcggacaagaactgcggcgaccacagcaagtggtgcaagctccggaagcgcttctggcgcgtcttagggtgcatcgtcggcttcataattctgatccttctcatcatcctcatcatctggctggtgctccgccccaccaagccccggttctacctgcagggcgcggtggtgctgcagttcaactacaccggcccacccagcaacctgctctccaccgtcttccaggtcaccatcgcctcccgcaaccccaacgaccgcatcggcatctactacgaccgcatcttcgtctacgccgcctacaagaaccagcagatcagcctcgccaccgccctgcccccgatgtaccagggccacaacgacgtcgtcatctggtcgccctacctcttcggccccaacgtcccggtggcgccctacctctgcgacgccctcacccaagacaaggcttccggcttcctcatcctccacgtcaagatcgacggccgcataagatggaaggtcggctcctggacctccgaccactaccacctcttcgtcagctgcccggccttcctcacctttcaaaacgggaggtcaggatccggcgccaccgtcaggttccagcagatgtccgcctgcagcgtcgaagtctaaggacgccgagctccagtttgtgtctttagcaggtttttttcttctctctttaggcttaattagccgtaacgcacgctgttccatgttatgtagcagaaggccaggctgtgtgatagacacattaaggggaggaggatgatgatgggagaaattaataatggtttataaattccaccaagatcaattgatgtatttgcaagccaaatgttgaatactaagcatcacatgtttat

SEQ ID NO: 46 - DNA, 1224 bp, Musa acuminata
agatacactaagaatgagttcgctgcgagcttcctcctccaaacttgtgtgggtggccgctttggtcgtgtcactcatggccttgtgtgaggcgcagctctcgcctaactactacgacaagacctgcccacaggtgctgccaaccgtcaagaaagccaccggtgccgcgatcgctcgagagcatcgcatggccgcgtccctcctccgcctccatttccatgactgctttgttcagggttgtgacgcgtccatcttgctgaacgatgcggcgggcatcgtgagcgagaagaacgcacgtcaaaacttcagatctgcgagaggatacgaagtgatcgacggcataaagtcggccgtggagaaggtgtgtccgggcgtcgtgtcttgtgctgatatccttgccatcgttgcacgagactcctccgtatacgtgggtgggccttcatggaaggtgaagctcggaagaagagactccaccaccgccaacaaagatctggcagagcaaaacctgccattagccttcgacgacctcgacacgctcacctccgtgttcgcgcggcaaggactcagcctcaaagacatggtcgtcctctcaggatcgcacaccatcgggctggctcagtgcgccaccttccgggggaggatatacaacgagacgaacatcgacgcgggattcgccaggacgcggcagcgccggtgccctccgaccgccggcaacggtgacaccaacctggccccgcttgacctggtcacccccggctccttcgacaacaactactacaagaacctgctgagtaagaagggcctgctgcactcggaccagctcctcttcaacggcgggtcgaccgacgccacggtggtggcgtacagcaaggaccaggcggctttcttcgccgacttcgcggctgccatggtgaagatgggcgacatcagccccctcactggctccgccggggaggtcaggaaggtctgcagcgtggtgaactaagtgctgttgtcagtgtgtgtgtgtgtgtgcgtcagatgcgtccaaatgggatggactgtgtcttatacgttgtcggtgtttggattgcctcgctatcgacgtttcggtcgatgcaatgcaaatggtttcttcgcgaagcccatatgtttgctatcaataatgaagtccacgttgatctaaagaacacataatctattgattgtattgtattcgattaactaatctattttattcaacac

SEQ ID NO: 47 - DNA, 1476 bp, Musa acuminata
cccggctcccaataaaacgccagcaatggccctctcctttcaactcctggacctttctttcctcctcacccaaggaacataagatacagctcttgcctccacgataagataaaccaccgagacggaaagagacagctagagaaagcgagcaaggtagtttaaggctgagaggggaagagcagagcagagagatgatcttgagagtagaagtgatggcttcttcttcttcttcttcttcctcgtccttcttcctcctcttgttgggtgttgcgctgttcctctccaatgaggctactgctctcccagaactgcccaacctcaccaccctcgcttttgaggaaggctatacacagctatttggagactccaatctcatgcttcatcgcgatggcaggagcgtccacctctccctcgaccggcggaccggtgctggatttgcgtcacaagacctctatcgccatggattcttcagtgcctccatcaaactgcctgcagattacgctgccggagtcgttgttgccttctatatgtcgaacggagatgtattcgagaagacacacgatgaattggatttcgaattcttggggaacataagaggcagggagtggagggttcagacaaatgtttatgggaacgggagcaccgcggttggtagggaagagagatacgggctctggttcgatcccacagaggactaccaccagtactccatactgtggagcggtgaaaggatcatattttacattgacgacatccccatcagggaggtggtgaggacccaagccatgggcggggacttcccctcgaagcccatgtccctctatgccaccatatgggatggctccacttgggccacctcgggcggccgctacaaggtcaactacaaatatgccccttacgaagccgagttcgccgaccttgtgctccatggctgcgccgtcgatccgattgaacacagaaccacctgtctgggatccgacgctgcagtctacgataccatcacaatgtcagcagatcaacggacggcgatggacaagttccgaaagaagcacatcacctactcgtactgtcatgatcgcgttcgttatccgacaccaccaccggagtgtaatctcggtcctgaagccgaggatttccttgcatcaggcgaggcaaagttgagctatcgccgccgccgcggtaagcgctacggccgcagctcggtggactcagttctctgagtcccagtggtttggatatcgaataagtggttcaggtactgcgaggggaatttattttttgtgtaccatctactctactattctggtgttgtatagcaaatttgaattgacgtcggatagattagattcacatttgtttaggtgacatgcatatgtataacctagtctgtccaagcttgttttggagtctcgtcttgctcaacagtggttcccgccctttctagtttcctgttccttgcaacataacttgtgttcg

SEQ ID NO: 48 - DNA, 867 bp, Musa acuminata
cccggagaccctcttcctcccatagccaggctgctgcctcctcccactcccggacccttttaatcctccgcgaaatcctattcttctcctcccctcctcccttggaatcggccacgcggttcaaggcaccgatttggtgttcgccttgttctcacataacaagattgaccggccgagcgattgatctggaaagaaaggggagggaggagaatggcggaagagcagcgatgccaggagggccaccgcctctgcgcgaacaactgtggcttcttcgggagccccgcgacgctcaacctctgctctaaatgctaccgcgatcaccgcctcaaggaggagcaggagcgacagcagcagccggcctcttctgccgccgcctctgcgatgctcaccgtcgcgaaatccttccctgcctcttccccagccgtcgtcgtggttgacgaggaggtgagcggcgcctccgtcccggccgccccgccggaggagacggagaagaagaagagcgcggcggaggggccgagccggtgcgcgaggtgccgcaagagggtggggctgacggggttccagtgccggtgcggggccacctactgcggcgtccaccggtacgccgagcaacacgactgcacgttcgacttcaaggcggccggccgcgcggccatcgcccgcgccaaccccgtcgtgaaggccgacaagctccacaagatctgaagaatctccaccctccgtctcccccttcccccggctcgatggacggccccgatctcgtcccggaggagaccccactcccttgtgatatgatgatgattgacggctttctggtggattgctttctccatttctttttttcttttttctttttaggtgctggtg

SEQ ID NO: 49 - DNA, 1396 bp, Musa acuminata
ggaaagagaagaaggcaacctcgactcaaatccaaccacttgactgtgactcgcccttcctcttcttttttagcttggcccttcacttgattccgacgcctccttcggtgttgccgacacttccgctggcaggcctttgttcctggtaggaatggggaggcaatcatgctgctacaagcagaagctgaggaaaggcctgtggtctcctgaggaagatgagaagctgatcaggcatataaccaagtatggccatggatgctggagttcagttcctaaacaagcaggtcttgagaggtgcggaaagagctgcaggttgaggtggataaactacctgaggcctgatctcaagagagggacgttctcaaagcaggaggagagtctcataattgaactccatgcagtgctcgggaacagatggtcacagattgcatcacgtttgccaggaaggaccgacaacgagatcaagaacttctggaactcctgcgtcaagaagaagctcaggcagagtggcatcgaccccaacactcacaagccgctcgcagagatggaagacaagacctctaactccggtgatctcaaagcccccgccacaaccttggagaaaaccaagcattcggtacacaagccggcatcatcatcatcatcatcaggcgagagcagaacatggaagaattcggtgacgccgaccaaaggcttcttccacgaccatgagagctcatcggcctgccacttatcccctcttccacagtcaggctttgcccctgactgcgctcctctcttcgaaatgaaccaggagttaaattgcagcacgatatccacagttctgctatcggttcccagcggaaacatctcagctttgatgagcctgaaaccaaatatcgatcttttccgtgatgaaattgatggtattcagtgcagcagtgatgtttatttgagtaacagtcgccggagcagcatgaacactggtagcgtaatcgagttgcaaagcagcacctccttcgacggtggcatcctccctttctcggagctgacgccagaaaagaacgcccacgtccagctcgaacgggaacacgaggacctcaaatggtcagagtaccttcaaggaaccattacggcatcggcaacaatccaaagccaaagtcatcctctgcaatatgacatcaagaccgaaagccaatctgtactcgttggtctgggcacttggcagcagaatcagcaaggacagcagcagttgcagtcctcaaacatctacggtaaggatttccatatggtatctgtaggtttcggacaggtttaaatcgagtcaagaaaggtagagatagcgactctcttccaactcttagagctcctctgtgtaatgggtgtatagacatgatgttcaagagtgataagccaa

SEQ ID NO: 50 - DNA, 2143 bp, Musa acuminata
ctcccctttgtgcctcctattctcttccatttctacgttcgttgcttgttttctagggtttcccaatcaaatccacacgcaaatttaggattcatatcctttttttttttctttggtgtttccgtggggttttggttctttgggtttgttcagatcggatccgaggatgttggagcagctgctgatctttacgcggggcgggctgatcctgtgggagctcggcaacgcgctcaagggatccccgatcgacgccctcatccgctcctgcctcctcgaggagcgctccgcggacgctgccttccattacgacgcccccgccggatgcgccgcgtacaccctgaagtgggccttcgacaacgacctcggcctcgtcttcgtcgccgtctaccagcgtatcctccacctcctctacgtcgacgacctcctcgccgctgcccgccgcgagttctctcgggtctacgagcccaagcggacctcctacgatgatttcgacgagaccttccgccagctccagaaggaggccgaggcccgggccgaggagatgcgcaggttcaagcaggccggccgtgcccccgcggcgcctggcaagaagcaagttcccggcgccgcttccaggggttccgggaagcaacggagtagtggtggtggcggttcggggaaagatgagtccgacggtgatccaggaaaaggtcgtcggtcagagaatggtagttctaaagggcatgagaatgaaataaagccgaattctcgcgcccagaatgtagtagtacacggaaaagagaacggagcccctcgagttgaggctttcgatgtaagtaagttacagaagttgcgatccaaaggtgctaagaagacggatactggtggtggtggctgtaaggctgccaaggcagagccgaaaaagattgcaaagaagaacagagtttgggacgattcgccttccgagtcgagactggatttcacagatccagtggatgatagaggcgaagggcctgaggttgtggtagcagatcagggagagagcatgatggataaggaggaaattgtaagcagcgatagtgagggtgaggaggatgaggaagtagagactgagaaacctggcacgaagaagaaggggtggttttcgtctatgctccagagcatttcaggtaatgctgtgttagagaaatccgacttgagaccagcactgaaagctctcaaggataggttgatgaccaaaaatgtggctgaggagattgctgagaagctttgcgaatcagtggcaacaagtcttgaagggaaaaaattgggctcctttacaagagtgtcttcaacagtccagacagctatggaggaggcgctccttcgcattttaactccaaaacgatccatcgacattctacgagatgtccatgctgccaaggagcaaggaagaccttatgttgttgtttttgttggtgtcaatggagttggaaaatctaccaatcttgccaaagttgcttactggcttttgcaacataaaattaatgtcatgctggcagcatgtgatacattcaggtcaggtgctgttgaacagcttcgcacgcatgcacgcagactccaaatacctatttttgagaaaggctatgagaaagatcctgcaattgtagcaaatgaagctatccaggaagctaaacgcaacaattcagatgttgttcttgttgacacagctggtcgaatgcaggataatgagccactcatgagagcactctccaagctcatcaatctcaacaacccagatctagttctttttgttggagaggctttggttggaaacgatgctgtggatcaactgacaaagtttaaccagaaattagccgacctgtccatggttcctaatgccaggttgatcgacggcatcttgctcaccaagtttgatacaatcgacgataaggttggagcagctctttccatggtttacgtttccggagctccggtgatgtttgttggttgtggtcaatcgtataccgaccttaagaagctcaacatcaagtccattgtcaaaactcttttaaagtgaatgtagttctttgctctctctctcattactgtttgctactcctgctttgactttaatcccctgtgacctcattttcttggcactggaagcaaataaatcataatg

SEQ ID NO: 51 - DNA, 1867 bp, Musa acuminata
ctctctctctctctctctctctctctctctctttctgttttgagtctgtggaaggagtaggtgctttggcaacttcatgactgaacattctaacaacagcttaattttttttgtttctgtaccataccatcctgattagttcctgtacatgcaaattatttgggcaggagaataggtttcttcttctctctcaagctagccactgtggtcttttgcagcatggacaactataaatggagagcagcagcatatgaggtgggagaaccttcttcttcttacaccatatcatatcatgaagccttattctccagagcttcagaatgggagcagcagaacaagcctgcagaacacccccaggatagtcctcctcctcactgccaccttgttcctcctcaccatcattcctctctatctcttccctttgctagccacatcgttcgcatggagaaacttatcctctccaccttcctccccttctccttctctttcttcttcctcttcatcttcttcttctcgtgacatgagccgtgacgccatggctggtgtgacgatggccaagagctcgtgtgatatctttaggggggagtgggtgcccaaccctaacgcgccttactacaccaacgagacgtgctgggccatccatgagcaccagaactgcatgaagtttgggaggccggacacggagttcatgaagtggaggtggaagccgaacgactgcgatctgcccatctttaacccggcgcagttcttggagctcgtcagagggaagtcactggccttcgttggagactcggtggggaggaaccaaatgcaatccctcatctgcctcctgctcagagtcacatatgcggtggatgcgtcggtcactgaagatgagaagttccggcggtatcacttcccaacccacaacttcacggtggccagcttctggtctccgttcctggtgagggcacacgaagccgaccccaatggcccaaccctcaccggcctcttcaacctccacctggaccaagtggacaccaactggaccacccagatgacgccgttcgactacgtcatcgtctccgccggccactggttcttccgccccaccatgttcttcgaggccgaccagctcgtcggctgccactactgcctccaccccaacgtcaccgacctgaccatgtactacagctaccggagggccttcagggccgcgctccgggccttcaacgacctcccgggcttcaggggcacggtgttcctccggaccttcgcgccgtcgcacttcgagaacggcgagtggaacaaggggggcaactgcgtgcggcagcggccgttccggggcaacgagacaaggatggacggctacaacctggagatgtacatggcgcagctggaggagtaccgggcggcggagggcgaggggaaggagaagggcgtcaggttccggttgctggacaccacggaggcgatgctactaaggccggacggtcacccgggccggttcggccaccgccccgacgagaacgtgactctctacaatgactgcgtccactggtgcttgccggggccgatcgacgcctggaacgatttcctgctccatatgctgaagaacgagggtggcagatcagccgccggccgacgatccaggaacgacaggaagtccacgatcaaataggtgatcgacattgcttctctttttgttcttagagcacgtaatttgtattttaattagtataccatactgtggtctacatgaattttggtttgttctttctccatgcatcaaaaggttgtagaaagctgtgtgataaggcattaccgtgagaccaatgtcaataattgttgtgctgaagctactgctgccttatcaccattaaataag

SEQ ID NO: 52 - DNA, 1673 bp, Musa acuminata
ctttctttatgttcctcaagttcataatgtggggactccttctgttcctccccctctctctctttctctctctcccccctcctctgacactgcagtcctcaatttctctgtttccatctatgtggtaagcttgatacctgatagtgcaagcaaagcaaacaccccacaccttattattgtttggtcaccaccccctaaaactttctcagttttccagtgtcctgaaaatttctgcttctctttctatattgttccaagctttgtgatccctcaatacttttgcaagtcccttatttagcttctcacaaccacaacccttcagccaaatcacatcaattcctttctctctcacttcttttcctttgctctcctatttgctttatttctcttcttcttcttcttccacctaagctcctcctaatgccctcttcttgccatggaaaccacaatggaggatatgctgaatcttcttatggagtaaaccaacaagagttttctggaataaactccatgcctactcccttccttacttccaagccttgaaaagaaaggatcacttctgctttacccctgcagcctagagagaggaaggacctcaaaaatagagagcacaaagtttaagagaatggatctttctggtcaagaaggagagatcccaatcccaataaccagtgtatatgttggtggtcatggccatggcagcatccatgacagccctcccatccaccacccctccaatggccctcctcctcctcccctatccactgccaccacagaggaccaccaccacaacaccaccaactcctacagcaccaagaaaggggtggtagtaaggtacagggagtgcctcaagaaccatgcagcttccatcggtgggaatgccactgatgggtgcggtgaattcatgcccagtggcgaggagggaactctggaggccttgaagtgctctgcctgcagctgccacaggaacttccacaggaaagagacagaaggagagccctgctgcgactggttctaccccctcagggggaggaaggtgatgggccacaagggcctcctcatctcaggatcagatgcatttggttacagccctgcatgcaatagcctcattccaagggccacacctcacaacatgatcatgcctctgggtgtcatgcagacctctgagtctgatgagatggaaggggtgggtgcaatgatggcaaggcctgtcgtggtgaagaagaggttcaggaccaagttcaccccagagcagaaggagaagatgctgagctttgctgagaaggtggggtggaggctgcagaagcaggaggagagtgtggtccagcagttctgccaggagattggggtgaagaggagggtcctcaaggtgtggatgcacaacaacaagcatcacttggcaaagaagaactctctccagcttgaatgaccactgaaatcctcttgcatcatcatgccaaatgctcatcttacaagttgagttttggtggtagcatgtcataactattttcttgtatcactttctgagattttctcttcattttccacactgtcataatcatgagtttaccaagctttagtgttaattatattaatgtttaggcattatggattgttgcatttcaatcagctggtgaagaagacaaccctcaattactgtttaggcattatgg

SEQ ID NO: 53 - DNA, 1335 bp, Musa acuminata
tgggtggcttcgggtgggagaggatggctagacttggaggtgaggcaacgttgacatcccgcctactcttcttcttcttgctatcgacggcggtgatgggtggcagcgcgacggtggagacaaggagaagtgtgctggggaatggcctcggcagaactcctcccatggggtggaacagctggaaccatttccactgcaacatcaacgagcggctcatcagagagactgctgatgcattggtgcatactggacttgcagggctgggttatcgctacgttaacatagatgattgctggggagaagccaatagagactaccagggaaatttagttgctaagcgatcaacatttccttccggcataaagtctcttgcagattacgtgcatgcaaaagggctgaagcttggaatctatagtgatgcagggtcacagacatgcagcagaactatgcctgggtccctcggatatgaacaacatgatgcaacgacgtttgcctcctggggggttgattacttgaagtatgacaactgcaacaaccctggtactaggccaagagaaaggtatgccaagatgagctacgctcttcggaattctggaaggaacattttcttctccctttgcgagtggggtgtagataacccagcaacctgggcgagcggtataggcaacagttggaggacaacaggcgacatctacgatagctggggcagcatgacatcgcgcgccgatgagaacaacagatgggcatcctatgccgggcctggtggttggaatgatccagacatgctggaagtaggaaatggtggcatgtcaacggaggagtatcgatcgcattttagtatatgggcattggtcaaggctcctttgttgattggatgtgatgtgaggacgattagcggagatgcattggagatactgagcaactcagaggtcattgcagtcaatcaagactaccttggagttcaagggaagaaggtattcggaggaggcagcgaagaggtttgggcaggtcggttgagtggagggaaggtggctgtggtcctctggaacagaggaagctcgcgggcgacgatcacagcgagatggtccgacatcggcctctcgtcctccaccgccgtcagtgttcgtgatctttgggcgcgtgcgaccatcgggtccgttcgagggcagctcgctgctacggtggctcctcatgcgtgcaagatgtacgttctgacgccgcggtagagccaaggcttgggagtagtgcagacgtgcgcaagcccagtctgcaccagtatgcactgcaactatgtaggatgtgattccactagtaattgcatgaacaagattctaa

SEQ ID NO: 54 - DNA, 1064 bp, Musa acuminata
ggttgctgaggattgagaaaagattgtatattttcatcttattctagttggtataatatcaaaatcattttacttgattaaaaaattatccctgcagcattaccattccatctacttttgtaggttgaaaatgtgtctggaatatccaactttatccctgtccttgttggtaacaaacagatatgttccgaatttgagaggatggaaggggtttttgctgactgctacgccagtagcattatatcccaaaatgcgattactgattcctctccaggctcatgtgacttttttgcatccaggcaatctgtgatgtcagcacttctcttggacattgcatggttaatgaaggcacctcatttggaagataaggaagcttttcggagtctaacaaacgtccagagattaacttctttgctaaaattcttactacagaatgagctttttagtgttcttcaagtaataatgcatcatctggatagtattgttgatgtcgatggctttgataagctagacaaatggactgatgttgaccaaaagctatttcacgagtaccttaaccatgcaagagagattctttatgagagaacacatgacatgagatcagaagcagaaatgagaaatccaatctgtggacttgtgccacaaagctctcagagtaatatgtgtggggagatttatacaaagcaaggaaatgaagcaattaaagattgcttattcttagtctcatttcagccggctgtggagcatgatgtaaatgttctgcttgtgaacgaagagatctcccacaggcagcactgtcaccataatctgggcaagaaatgtgcttttgacgatattttctcaaacaagatcacgaggactcgctttcctttgtttgtaatagttaccgttgttttgtgtttagcagcatgtatcatcctcctccacccacacgaggtgggggagattgcagtttccattagaaggtgcatgtttggtggctcccctgcatgaaatgaaattaaccctttttgtttcacttgtgtcctatgtacagtgtagaattgtttagcttgcactgtttg

SEQ ID NO: 55 - DNA, 1772 bp, Musa acuminata
ggctcttgggatacaaaatcttatcgataggaagcctgctgaagcctgacgaagaagagagagatgaggaaggagagcttggccttgttggcgaccctcgtgctgctgctgccaaccaccgaatccaaactcagcagggatgacttccctccgggcttcatctttggagcaggaacttcggcttaccaggtggagggtgctgctgctgaggatggtaggactccaagtatatgggatacgtatactcgtgcagggggaatgctggacaatagcacaggagatgtgacttccgatcaataccacaaatataaggaagacgtgaagctaatggttgatacaggactcgactcctacagattctccatctcttggtcgaggcttctaccgaatggaagaggagccattaatccgaaaggcttggcttactacaacaatctcatcgatgagctactgagatatggaataacgccacatgtgacaatctatcattatgatcttccacaagtacttgaagacgagtacgaaggatggctgagccataaaattgtggaggacttcacagcatttgccgatgtctgcttcagagaattcggcgatagggtgtctcagtggaccaccatcgccgaacctaatgtaatagcgatagggtcattcgacaatgcaatatttccacctagccgatgttctaatcctttcggcttattcaattgcaccgtcggtgactccaccaccgagccatatactgcagctcacaacttcttattggcgcatgcatctgttgtctcattgtacagaacaaagtatcaagccaaacaaaatgggaggataggcttgaatgtgtactccatgtggtgttatccatcgacgaactcaacattagacttgcaagcaacccaaagattattggacttctacgtaggctggatcataaatcccctggtttttggagactacccaaaggtcatgaagaagattgtccgctcgaggctcccttccttcacggaggagcaatcggagcaactaaagggttcattcgacttcatcggcctgaatcattattcatcgatctgggtcaaggacaactccaatgcctccgagactgcacctcgtgatttcaacgcagatctctttgccaaattcgcattttcaaagaacgatacaccaggcagtcagttagtccctactgacatacccttcgatcctgctggcctgcaacatctgttggagtacatcagagacgcatatggaaatcctccggtttatatcgaagaaaatggttatggacttggattaaatgacacaatctccgacgtcaagagggcgaactacttgagtggttacattggcagcacgctcgatggtattaggaagggagccaatgtgaagggatactacgtgtggtcatttctagatgtcttcgagttcttgtctgggtttcagtcaccattcggactataccatgtggatttcaaagatgaaaaccgcacaagacaacctaagctctctgcactttggtactccgacttcctcaagaagaagaagactagcacgaatataaacatgatgggactgcaccaaagatctcactctcaacggtgactcatgtgatggttatcctgttgctttggataaagagtgaagttgcatcatggtttcctacaatgttctctcttcgtcttcgtcttcgtctcgtctcctcacatcttcatttgcttactatatatgctgcttcgtgtcatcctctctattgttacttcttcttatttatttcg

SEQ ID NO: 56 - DNA, 1482 bp, Zea mays
actccaaagccaacaaacagagctccaactcagaaagcatccgtcccttggcagcagcaacaagctactagctatgtgtgtttagagcgagcgagggaaaaaaaagaaaacatctaagatatactccatcatcttcgtttgattaacccgcccagtaaagccatgggtactaatgatagagcggtcatttctctagtactcctcgtgtgcatcgctagccgctcgtccttgggtgccgctgaaactgacgttgagcagaagcgcttgtcagtcccgttgatgtttgtgttcggtgattcgctggtcgatgtcggaaacaataacttcctgccgccgcctgcaccccgtgctgcatctccgtacggcatcgacttccctgctggcacccccggcgccgtctcaggacggttcacgaatggctacaaccttgccgatttagtcgcgcgacgtctggggttcaagatgagtccacctgcttacctctcgttgacaccggtatcaaagtttgacctgttcacgtgccgaattggtgccaattacgcgtctggcggatctggcattctcaacaccacgggaaacgggacactcacgctgcagaaacaaatcacgctgttctccaaaactcaagcaagaatgtcgtgggcccgctgcaagctcaggtctatggtatcgaggtccttgttccttatcagcgccggcggcaatgacttctccgccttcagtgaaatgggcatgggcgaacaagacgccccagcctacatcagtagcatggtctcaacctatgtccagcatatcgacgcgttgtacaagttgggagcacggaggttggggatcctagacgtgccagcgatcggctgtaccccaggctccagagtccccatggccaacggcggatgcaacgacgctgccaactctatggcgcagaacttcaacaaactcctaaggctcgaggtggcgaaagccgtcgcatcctccatgcccggcatgagatactccattgcaagcacctacaattttgtcaccgacttgatggacagccatctagtggctgggctccgggtggtcgacagggcatgctgcggatcgggaaaactgaacgccgcggtcatgtgcgcccagccaaacacgacttactgttcggatcgcgacgactacatgttctgggacatgctacatcctacgcaggcaacaaatgaacgtggggtggtcgccatcttctacggcccgcaggagtacgcggatcccatcaactttgcacagttggccgctgccacagcaaatgatgatgatgatataaatactgctatgaccgcaggcgtctatgccgccatatgataaacactatttatgtctattggcatgcagctgcgacatgtcactacctgagtactatatacgtaattcagttggaataatgtacgttgtgtgcatcatcagtctctctctatatatgctggaaataaaatgaagacaagagaccac

SEQ ID NO: 57 - DNA, 2372 bp, Triticum aestivum
gatcatcatcgtctcctcaaggccatagctagctagctccactatacagaccaccgagggcgcatggcgctgacgagtcacctcctggtcgtcctcctcggcatcgcagtgccgctgctcttcttctcccgtgcagaggggggcgaggtaggcgtgtgctatgggaggatggcgactaacctgcctgacccggcgaccgtggtgcaactgctcaagaagaacagcatcaccatggtgaggatctacgacaccgacccgacggtgctgcgctcgctggccaacaccggcatcaaggtcacggtggagctaaccaacgaggagctgccctccgctgccacggaccaaaatttcgctgatcaatgggtgcagaacaatgtcaaggcgtactaccctgccacactgatcaatggcgtgacgatcgggaacgaggtcttcaaagaggctagtcagttgaactctcagctcgtcccggccatgaagaaggtgcaagcggcgctggctcgcctgggcctggcggacgccgtgaaggtgaccacgcccatcgcgttcgacgcgctcaagatgtcgttcccgccgtccgagggcgcgttccgtgacgacatcgcgttgtcggtgatgagccccatggtcgacttcttgcaggaaaccgggtcgtacctcatgatgaatatctacccgtaccttgcgtacctgagtactcccggcatgtccatcgactatctcttgttccgccccaacgttggcgttgttgacaagaatagcaagcaaacgtacttcagcctcctcgacgcgcagcttgacgctgtgtactatgcgatggagaagctgccgtcctccagcctgcgtgctggggggatgaggaagctcacagcagggggcggaatactggaggtgaagcttggtgagagtcaccacccaaccagaggccaccatggcgtgggaacaagagccaacgcccaagcgttcaccgatggtctcatgagcaaagtgcgtggcggtaactccggcaccacctcaaacaaatataaccggctcgccaccagtgctgtcggcaccccgcaccgtcccaacgccgatcttgacgtgtacatcttcgaactcttcaatgaggacaacaagcccgaagacgagcaggacttcgggttgttctacccaaaccagcagcccgtgtaccaagtcgacttcgtccatggtgccggccccgtgcaaccgagctactgcaccgcgaaggccacagccggggacgcggccctgcaggcggcgctggactacgcgtgcggccacggggcggactgcagcgccatccagccaggcaagccctgctacaagcccaacaccaagcttgcgcacgcgtcgtacgccttcaatgactactaccagaagaacggccgggccagcagcgcgtgcgacttcggcggtgccggcaccattgtcaaccaggcaccatcaggccgctgcgaccttagcccgagctggtgtgtcgcgaacgcagcggtgggcgccgcacggctgcagaacgcgctggactacgcctgcggtcatggcgcggactgcactgacatccaacctggagcacggtgcttcgatcccgacaccaaggtcgcccatgcgtccttcgcgttcaatgactattaccagcgccataaccaggccgccggaacgtgcgacttcgccggtgccggtaccattgtccggcaggcaccaaagataggcaactgcgtgctgccgtcaagggcctgaactgaagaaactgtagccaaagcgaagctttactaccacgagattaagcaataatcccgacagattattgtctgctgccggcaaagtctagttttcaaatgtaaaactgcatgcttttcatcaggtgcttagagcaagtacaataatgggcttatagcctggttacgtgtcacttttgcctatgtgaaaaggagtgatgtggaaaaatagtgggagaggactctcatatagagcctagctctatgcttactcctaggcaattgcaataaatatgaagaaagtgatataaagagatgaaaaaaaaatattcttatagctaaccttattgcatgagtgactatacaataatgctaaacatacaaagagttacacgcaattacacgctgactaggattttttacatctactaaccaatcacaaacttgcttcctcctgattttcaggaggggtggaccgcctccctatctattgacccatcaaattaactttctttgtaaaactccgtaactcatttgtacgtgtagcattactgttccacgaaatgcataaaccagaaaagtaactccgttatatattgccgatcggctcggaccggccaaatctgaagtaaaaaaaaaacacttggctaagga

SEQ ID NO: 58 - DNA, 976 bp, Triticum aestivum
cttccttcttccagcaatggcggctttgaccggggcagcgctcctcctcgccagcctccttgctctcgcagccatcaccagcggcaacaccgaaggtgacatcctctactcgcaaaggcaggcgtggaaggaccccaacaacgtgctgcagagctgggatccgacgcttgtcaacccctgcacttggtaccatgtcacctgcaacaacgttaactccgtcatccgagtggacttggggaatgcaggcctctcaggcgccctggttcctggactgggacgaatggtgaaccttcagtacctggagctgtttgggaacaacatcagtggaccgattccagcaaccctcggcaacctgacacgcctggtcagccttgatctctatgacaaccgtctcaccggcgcgataccagcctcgctcgggaacatcgagacgctgcgtttcctgaggctgcatgggaacaagcttgcaggtggaataccggcgtcgttgggccgtctgaagaagcttcaggccttggagctccaggaaaacatgctgagcggcacggtgccgcgggaggttctctcccttgttcttgtcggggacttgactgagcttaacgttgcaaagaacagtctggccggcactgtcaaatcttctaaaccaagagtagctactgtcatccaggacacgctcaagactacacgtctacacgctgagcagcactgacaacctgaacttttgtaagaataaactgaatgttttttccttctgaaactgctgggagaggctgtagccttctatcccgttaagtgtccggaatttaactccatttctagagagaaaaaggggaaaggcgtaaggtagttgaatgcactgtaatcagtgtgacttcgtaataatgaatctttctctgcacctttagtgcatatgcagtgttatcggtttggcatattcatatctaccgtatgtcgtcgatcgttgttttcatcgctt

SEQ ID NO: 59 - DNA, 563 bp, Triticum aestivum
gagtagatcgacaggactgggaagagatttgctccacaagttcaggaccaaccaacgatgaagaacagcacgcttgtggcgatcctggtcgtcctccaggccatcatggtcataggaatcctttcacacgccgccgatgacaatttccccaagtgctgcgaccactgcaactcctggtcggggtaccaattctgtgacgacgtcggccccaggtgccgcgacggctgcgtcaactgccacgtggtggaaacgagccccgtgaagacgttccggtgtggagatggacgccccgtcctcggcgggcaaggcacgcccacgccctgcccaccaccgtgcaaaaagcattgatcgctagagctcagacagtgagatcgatgttgcgcctaaaacataaaataaaaaggctccgatgagatgagcagagccactcccagcgttctctttcctttgagagataatatagttgatgttgctttaaataaataaacacgggtatcagtttgtatatacgtctctgcttaatcaaataaaaaacagtttatttgtgcgatgtaaaaaaaaaa

SEQ ID NO: 60 - DNA, 4528 bp, Oryza sativa
agcgtccaaggcctcagcctccgccctccgccgccggcgagcagagccccaattcgccattgctgcggcagtgagtgtagcagtctccaactttatccgtcacagctaaaagttagtccactcaatacactcattgcctcatcatcgtgtcaaattaaagccgtgctttccacgcagattccccggctaaaccggactaaattaagacaaactgagactgaaaagaactcaaatcgataaacgtgagtgaatcggcccgggccacctcatgtggcacttgcgggggaggagctccgtgaccgcagcagcagccgcagcgctacataaaccggtcgcccacctgcgcctcctcctcgcagtctccgcctggtccgtccccgccgcagcctccaacgtcgcggcggcttcgactacgactcgaggcggcccgagccctagcgcgggcgtcgcgcctagagcgatgccttcctcgtcctcctcgccgccttccgccgccgaggggacgaccgctgcagcgggtgggttccgcctcaccgagccctcgttcctcgagtcgctgatgccgaagaaggagatcggcgtcgaccgcttcctcgccgcgcatcccgagtacgacggccgcggcgcgctcatcgccatcttcgattctggagttgatccggctgcagctggtttgcagactacttcagatggaaagcccaagatccttgatgttattgactgcacgggtagtggtgatgttgacacgtccaaagtggtgaaagctgatgatgatggttctattgttggtgcttcaggcacccatctgactataaatccctcatggaagaacccttctcaagagtggcatgttggctgtaaattagtctatgaactcttcacggacacacttacctctcgtttgaagaaagaaagaaagaagaaatgggacgagcacaaccaagaagcaatatctgaggccttgaaacagctgaatgaattcgaaaagaaacacagtaaatctgatgacgccaaacaaaaaatggctcgtgaagacctgcaaagcaggcttgagtacctgaggaaacaagcagaaggttacgatgacagggggccggtaattgatattgttgcatggcacgatggtgatgtgtggagggttgctgttgatacccagggccttgagggcaacaaaaattgtggaaaacttgcagattttgttccattgacaaactacagacttgagcggaagtttgggatttttagcaaattagatgcttgctcttttgtagcaaacatttacgatgatggaaaccttgttagtatagtaactgattgctctcctcatgctacccatgttgcgggcattgcagctgcttttcatcctgatgaacctttgctcaatggagttgcaccgggtgcacaactgatttcctgcaagattggcgatacccgtttaggatcaatggagacagggacaggcctggttagggccttgatagctgcagtagagcacaaatgtgatctgattaacatgagctatggagagcctacccttcttcctgactatggcagatttattgatcttgctagtgaggttgtagacaagcatcgtattatatttattagtagtgctggaaacaatggtcctgctttaaacactgtcggtgctcctggtggtactagttcaagcattattggcgttggcgcttatgtctcaccagctatggctgctggagctcactgtgtcgtacaagcaccagctgaggggatggagtacacatggtctagccgaggtcctactgctgacggggatcttggtgtctccattagtgcaccgggtggagcagtggctcctgtaccaacatggacacttcagtctcgcatgctcatgaatggaacttccatgtcatcaccttctgcctgcggtggggttgctcttcttgttagtgccatgaaggctgaaggcattccattaagcccttatactgtgaggaaggcaattgagaatacagctgcatcaataagtgatgtgcctgaggagaagctaaccacagggcatgggcttttgcaagttgatagggcttttgaatatgctcaacaggctaaggaattgccacttgtttcttatagaatatcaatcaatcaagtgggcaagccaacttctaaacttagaggaatatatctacgtgggagtaacacatgccggcaaacaagtgagtggactgttcaactagacccaaaatttcatgaggatgcaagtaacatggagcaattggttccatttgaggagtgcctgcagctgcattccactgatagctctgtcatcaaaattcctgagtacataatggtgacaaacaatgggcgcactttcaacattgttgtaaatcctgttaatatcagcagcggccttcactattatgaagtttatggtatagattgcaaagcaccatggcgtggacctattttccgcgtaccaatcactgtaataaagcctattgctctatcaggagagccacctgcattgacactttcaaatctttcctttaagtcaggtcacattgaaagaaggttcataaatgtgcctattggagcttcatgggtggaagttacaatgcgcacatcagcctttgatactcctaggaggttctttttggacactgttcagatctgtccactgaagcgacctattaaatgggaggctgttgtcactttctcttcaccttctctcaagaatttcagttttcctgtagaaggtggcttaactttggagttgtccatagcccagttctggtctagcggaattgctagccatgaacctacctgtgttgattttgagattgtgtttcatggaatatccgttgatcagaaaataattggccttgatggtagtgaggcacctgtgcgtgttgttgctagatctctattagcatcagagaggcttgttcctgttgccactctgaacaaggtcaagaccccttatcgaccagtggagtctaatctttgttcacttcctcccagccgtgatagattaccatctggcaagcaaatcatagcactaactctgacttacaaattcaaactagaggatggtgctgaaataaagccccgtgtgcccctacttaacaacagaatatatgataacaagttcgagtctcagtattatagaatatcagattcaaacaagtgtgtctactcttctggtgacgtctatcctaattatgtcaaactctcaaaaggtgaatacacgctgcaattgtacataaggcatgacaatgtgcagttattggagaaactgaagcagttggttctatttatcgagaggaagctagagaaaaaggatttcattcaattgagtttctactctgaacctgatggccctacagttggaaatggcaccttcaaatcctctattttagttccaggagaaccagaagcattctatgtgggtccaccatctagagaaaaacttccaaagaatgttctacctgggtctgttttggttgggtcaattacctatggtgcggtaagctctttcagcaagaaagatgaccaaaaccagcatgctccagcatcttatagtatctcgtatctcattccaccatcaaaggttgataatgataaagaaaagggagtttcatctggaagaaagagtatttcagagagattggatgacgaggttcgagacaccaagataaagttcctttctggctttaatcaagaaactgaggatgacaagtcttcttggacggcacttgttgcttctcttaagccagagtatcccaagtatacacctttgcttgccaaaattttggaatgcatagttcagaaagcaacttcagatgataagtttagccatcaaaaagagattatagctgcagctgatgaggttgtggacagtattgataaagaggatctggcaaagtctttgtcccttaaaccagatcctgaagatgaagaggcacagaaaaataagaaaaagatggaagaaacacgagaccagttggctgatgcactataccaaaagggtcttgcattggcagagattgagtcgctaaagactgatgagtcaactgaggcatctgctaaagatgtttttgaagagaattacaaagaattaattaaatgggttgatgccaaaactacaaaatacggctctttaactgtcctgcgtgagaggcgctgtggaagacttggcactgcattgaaggttctgaatgacatgattcaagatgactctgagcaaccaaagaaaagactttatgatttgaagatccaattgattgaggagataggatgggtccatgtatcggcctacgagaagcagtggatgcatgtccgatttcccccatctttgcctccgttttaattgttaggactatttttcactcatttttcatcaccatggattcagtattttactatttttgtcattgttggtagcaaacttgctggtttggtagtttttcactaggtattttatttcttcaaatggtaataagaacttaagaaggctgcctgctactgctaagctcatcggtttgtgcag

SEQ ID NO: 61 - DNA, 1590 bp, Musa acuminata
aaaggagatgagggaagggagaccagcctggttgctaatcctaggagtggtactcctgctgtttttgtcttcgttagcagagggttcggggcaactgacggagcccagcttcagcagagctgacttcccttcagacttcatcttcggagctgggacgtcgtcttatcaggtggagggagcagtatctgaggatggaaggaaaccaagcatttgggacacctttactcatgcagggcgaatgctggacaagagcacaggagatgtgacttccgatggctaccacaaatacaaggaagatgtcaagctgatggctgaaactggattggactcctacagattctccatctcttggtccaggcttatcccaaatggtagaggagctgttaatcctaaaggcttacagttttacaacaacctgattgatgagctagtaaaatatggaatcaaacctcatgtgtcactataccatcttgaccatccccaagcacttgaagatgagtattcaggatggttgagccccaaaatggtggatgatttcacagcatttgcagatgtttgcttcaagaattttggtgacagagttcctcggtggacgactgttgtcgaacccaatataatgtcaatgggtgcatatgacgtggcaatacttccaccaaatcgatgctcttatccatttggcatcaattgcaccgtaggaaattcgacgacagagccctacattgtggttcacaacgtcctattagcccatgcatcgatcgtcaaattatacaaaagcaaatatcaagtagagcaaaatgggtggataggcatcaacgtatacactttctggtattatccactcacaaactcttctgcagacattgaggcaacccaaagaatgctcgagttttatgttggctggatcctaaatccgttggtgtttggagactatcctgaggtcatgaagaagatcgtcggctcgcgactcccatccttcaccaaatctcagtctaaacaaataaagggcttatttgatttcattggcgtgaatcactattcttcaatatatgtcaaagataacatcaatgcttctgagatgggtcttcgcgactttgctttggattccttagccttgatgataacttcaaggaatgagacacctggccagtatgaccctacggcaccttcatcattcgatcctcaggggctgcaatacatgttggagtatctcagagatgcctacggaaatcctcctctttttgttgaagaaaatggctatggcataggaaggatagagagcgacggccttaatgacaccgataggatcaattacctgaatggcttcatcggtagcatgctcgatgctatcaggaatggagcgaatgtgaaaggttactttatttggtcgttcatagatgtcttcgagttcttgactgggtatcaatctcgttgcggattgtaccatgtggattttgacgatgaaaaccggaaaagaaagccgaagctctctgctggttggtactctaagcttcttgaaggaaaggatggcatgaaactaaacaaaactgcaatggatacagaataccatgctcggtggtaacattcctccaa

SEQ ID NO: 62 - DNA, 1227 bp, Musa acuminata
atggctaagaccaacctcccaccgggcttccgttttcaccccactgatgttgagcttgtttggtactacttgaagaggaaagtaatgggaaagcctttccggtctgaggctatttctgaagttgagctatacaaattcgccccttgggaactcccaggaaaatctcggttgcgcacaagggatcttgagtggtacttcttttgccatcgtgataaaaaatattcaaatggctctcgatcaaatcgagcaactgatggtggttattggaaggctactggaaaagacaaatctgtcgttcacaactcttgtacggttggtatgagaaggactctagtttttcacgaggggaaaccaccaaaggggacaaggactaactgggtgatgtatgagtaccgactagagagcagggaattggttgatgctggattcgcacaggacgcttacttactctgcaaagtattccaaaagagtggtctgggtcctagaattggggagcaatatggtgcgccatttaacgaagaggactgggaggatgacacggctattgagagttcctttcctcttccttgtgtatcttcttgcctgagtgcagaaccattagataaccaagctatacaggcggatccagttagcaaacagcctatagcttccagtgctgttgagttactttccgatcatgatcttcttgatgttgatggaatatcgctggaggagttggcagagtttcttaatagctctccactcgtagagaatgctaatgacaagatgcctgatttaaccattcctagcatgaatgttaatgaagctgcagctatggtccctgaaggagtatataatgaattagacgatctctctactggggaattgatttctggcaatatcgatctaattgaaaacattctcaatgaaactgccttgtgtcctacgctacaagaacttgatagtaaacagtatgttgagctgaatgatcttattggggatggaaatccctatgtgtctgtcgagccaagtactccatttgccccaaacccatctggtcattggcccgatttggagaatctgaatcacatccttgatccaatcccttactttgataacgatgtttttggtggtatgcgtggtcttcctcatacaggacctgatacaacaagccaacattggtcaccgggcatgcagattggagattttggtgaatttgtgcccccacttgaacgatcctctttctga

SEQ ID NO: 63 - DNA, 633 bp, Musa acuminata
atgtcggacaagaactgcggcgaccacagcaagtggtggaagctccggaagcgcttctggcgcatcttagggtgcatcgtcggcttcataattctgatccttctcatcatcctcatcatctggctggtgctccgccccaccaagccccggttctacctgcagagcgcggtggtgctgcagttcaactacaccggcccacccagcaacctgctctccaccgtcttccaggtcaccatcgcctcccgcaaccccaacgaccgcatcggcatctactacgaccgcatcttcgtctacgccgcctacaagaaccagcagatcagcctcgccaccgccctgcccccgatgtaccagggccacaacgacgtcgtcatctggtcgccctacctcttcggccccaacgtcccggtggcgccctacctctgcgacgccctcacccaagacaaggcttccggcttcctcatcctccacgtcaagatcgacggccgcataagatggaaggtcggctcctggacctccgaccactaccacctcttcgtcagctgcccggccttcctcacctttcaaaccgggaggtcaggatccgacgccaccgtcaggttccagcagatgtccgcctgcagcgtcgaagtctaa

SEQ ID NO: 64 - DNA, 1213 bp, Musa acuminata
atgagttcgctgcgagcttcctcctccaaacttgtgtgggtggccgctttggtcgtgtcactcatggccttgtgtgaggcgcagctcacgcctaactactacggcaagacctgcccacaggtgctgccaaccgtcaagaaagccaccggtacggcgatcgctcgagagcatcgcatggccgcgtccctcctccgactccatttccatgactgctttgttcagggttgtgacgcgtccatcttgctgaacgatgcggcgggcatcgtgagcgagaagaacgcacgtcaaaacttcagatctgcgagaggatacgaagtgatcgacggcataaagtcggccgtggggaaggtgtgtccgggcgtcgtgtcttgtgctgatatccttgccatcgttgcacgagactcctccgtatacgtgggtgggccttcatggaaggtgaagctcggaagaagagactccaccaccgccagcaaagatctggcagagcaaaacctgccaatagccttcgacgacctcgacacgctcacctccgtgttcgcgcggcaaggactcagcctcaaagacatggtcgtcctctcaggatcgcacaccatcgggctggctcagtgcgccaccttccgggggaggatatacaacgagacgaacatcgacgcgggattcgccaggatgcggcagcgccggtgccctccgaccgccggcaacggtgacacagacctggccccgcttgacctggtcacccccggctccttcgacaacaactactacaagaacctgctgggaaagaagggcctgctgcactcggaccagctcctcttcaacggcgggtctaccgacgccacggtggtggcgtacagcaaggaccaggcggctttcttcgccgacttcgcggctgccatggtgaagatgggcgacatcagccccctcactggctccgccggggaggtcaggaaggtctgcagcgtggtgaactaagcgctgttatcctctctctctctctcactctctctcactgtgtgtgtgtgtgtacgtcagatgcgtcaaatgggatggactgtgtcttatacgtcgtcagtgtttggattgcctcgctatcgacgttccggtcgatgcaatgcaaatggtttcttcgcgaagccccatatgtttgctatcaataatgaagtacacgttgatctaaaaaaaaaaaaaaaagtcgacatcgatacgcgtggtc

SEQ ID NO: 65 - DNA, 1074 bp, Musa acuminata
agcaaggtagtttaaggctgagaggggaagagcagagcagagagatgatcttgagagtagaagtgatggcttcttcttcctcgtccttcttcctcctcttgttgggtgttgcgctgttcctctccaatgaggctactgctctcccagaactgcccaacctcaccaccctcgcttttgaggaaggttatacacagctatttggagactccaatctcatgcttcatcgcgatggcaggagcgtccacctctccctcgaccggcggaccggtgctggatttgcgtcacaagacctctatctccatggattcttcagtgcctccatcaaactgcctgcagattacgctgccggagtcgttgttgccttctatatgtcgaatggagatgtattcgagaagacacacgatgaattggatttcgaattcttgggaaacataagaggcagggagtggagggttcagacaaatgtttatgggaacgggagcaccgcggtcggtagggaagagagatacgggctctggttcgatcccacagaggactaccaccagtactccatactgtggagcggtgaaaggatcatattttacattgacgacatccccatcagggaggtggtgaggacgcaagccatgggcggggacttcccctcgaagcccatgtccctctatgccaccatatgggatggctcaacttgggccacctcgggcggccgctacaaggtcaactacaaatatgccccttacgaagccgagttcgccgaccttgtgctccatggctgcgccgtcgatcccattgatcacagaaccacctgtctgggatccgacgctgcagtgtacgataccatcacaatgtcagcagatcaacggacggcgatgggcaagttccgaaagaagcacatcacctactcgtactgtcatgatcgcgttcgttatccgacaccaccgccggagtgtaatctcggtcctgaagccgaggatttccttgcatcaggcgaggcaaagttgagctatcgccgccgccgcggtaagcgccacggccgcagctcggtggactcagttctctgagtcccagtggttt

SEQ ID NO: 66 - DNA, 772 bp, Musa acuminata
atggcggaagagcagcgatgccaggagggccaccgcctctgcgcgaacaactgtggcttcttcgggagccccgcgacgctcaacctctgctctaaatgctaccgcgatcaccgcctcaaggaggagcaggagcgacagcagcagccggccccttctgccgccgcgtctgcgatgctcaccgtcgcgaaatccttccctgcctcttccccagccgtcgtcgtggttgacgaggaggtgagcggcgcctctgtcccggccgacccgccggaggagacggagaagaagaagagcgcggcggaggggccgagccggtgcgcgaggtgctgcaagagggtggggctgacggggttccagtgccggtgcggggccacctactgcggcgtccaccggtacgccgagcaacacgactgcacgttcgacttcaaggcggccggccgcgcggccatcgcccgcgacaaccccgtcgtgaaggccgacaagctccacaagatctgaagaatctccaccctccgtctcccccttcccccggctcgacggacggccccgatctcgtcccggtggagaccccactcccttgtgatatgatgatgattgacggctttctggtggattgctttctccatttctttttttctttttttctttttttctttttaggtgctggtggtggttaaaaaaaagcctggaaaatgtaaactattattaattagtagttcccacttatttttcttttaaaaaaaaaaaaaaaaagtcgacatcgatacgcgtggtc

SEQ ID NO: 67 - DNA, 1151 bp, Musa acuminata
atggggaggcaatcgtgctgctacaagcagaagctgaggaaaggcctgtggtctcctgaggaagatgagaagctgatcaggcatataaacaagtatggccatggatgctggagcttagctcctaaacaagcaggtcttgagaggtgcggaaagagctgcaggttgaggtggataaactacctgaggcctgatctcaagagagggacgttctcaaagcagggggagagtctcataattgaactccatgcagtgctcgggaacagatggtcacagattgcatcacgtttgccaggaaggaccgacaacgagatcaagaacttctggaactccggcgtcaagaagaagctcaggcagagtggcatcgaccccaacactcacaagccgctcgcagagatggaagacaagacctctaactccggtgatctcaaagcccccgccacaaccttggagaaaaccaagcattcggtacacaagccggcatcatcatcatcatcatcaggcgagagcagaacatggaagaattcggtgacgccgaccaaaggcttcttccacgaccatgagagctcatcggcctgccacttatccccccttccacagtcaggctttgcccctgactgcgctcctctcttcgaaatgaaccaggagttaaattgcagcacgatatccacagttctgctatcggttcccagcggaaacatctcagctttgatgagcctgaaaccaaatatcgatcttttccgtgatgaaattgatggtattcagtgcagcagtgatgtttatttgagtaacagtcgccggagcagcatgaacactggtagcgtaatcgagctgcaaagcagcacctccttcgacggtggcatcctccctttctcggagctgacgccagaaaagaacgcccacgtccagctcgaacgggaacacgaggacctcaaatggtcagagtaccttcaaggaaccattacggcatcggcaacaatccaaagccaaagtcatcctctgcaatatgacatcaagaccgaaagccaatctgtactcgttggtctgggcacttggcagcagaatcagcaaggacagcagcagttgcagtcctcaaacatctacggtaaggatttccatatggtatctgtaggtttcggacaggtttaaatcga

SEQ ID NO: 68 - DNA, 1948 bp, Musa acuminata
ttgggtttgttcagatcggatccgaggatgttggagcagctgctgatctttacgcggggcgggctgatcctgtgggagcttggcaacgcgctcaagggatccccgatcgacgccctcatccggtcctgcctcctcgaggagcgctcagcggacgctgccttccattacgacgcccccgccggatgcgccgcgtacaccctgaagtgggcgttcgacaacgacctcggcctcgtcttcgtcgctgtctaccagcgtatcctccacctcctctacgtcgacgacctcctcgccgctgttcgccgcgagttctctcgggtctacgagcccaagcggacctcatacgatgatttcgacgagaccttccgccagctccagaaggaggccgaggcccgggccgaggagattcgcaagttcaagcaggccggccgtgcccccgcggcgcctggcaagaagcaagttcctggcgccgcttccaggggttccgggaagcaacggagtagtggtggtggcggttcggggaaagatgagtccgacggtgatccaggaaaaggtcgtcggtcagagaatggtagttctaaagggcatgagaatgaaataaagccgaattctcgcgcccagaatgtagtagtacacggaaaagagaacggagcccctcaagttgaggctttcgatgtaagtaagttacagaagttgcgatccaaaggtgctaagaagacggatactggtggtggtggctgtaaggctgccaaggcagagccgaaaaagattgcaaagaagaacagagtctgggacgattcgccttccgagtcgagactggatttcacagatccagtggatgatagaggcgaagggcctgagattgtggtagcagatcagggagagagcatgatggataaagaggaaattgtgagcagcgatagtgagggtgaggaggatgaggaagtacggaatgagaaacctgacacgaagaagaaggggtggttttcgtctatgctccagagcatttcaggtaatgctctattagagaaatctgacttgagaccagcactgaaagctctcaaggataggttgatgaccaaaaatgtcgctgaggagattgctgagaagctttgcgaatcagtggcaacaagccttgaagggaaaaagttgggctcctttacgagagtgtcttcaacagtccagacagctatggaggaagcgctccttcgcattttaactccaaaacgatccatcgacattctgcgagatgtccatgctgccaaggagcaaggaagaccttacattgttgtttttgttggtgtcaatggagttggaaaatctaccaatcttgccaaagttgcttactggcttttgcaacataaaattaatgtcatgctggcagcatgtgatacattcaggtcaggtgctgttgaacagcttcgcacgcatgcacgcagactccaaatacctatttttgagaaaggctatgagaaggatcctgcaattgtagcgaaggaagctatccaggaagctaaacgcaacaattcagatgttgttcttgttgacacagctggtcgaatgcaggataatgagccactcatgagagcactctccaagctcatcaatctcaacaaccctgatctagttctttttgttggggaggctttggttggaaacgatgctgtggatcaactgacaaagttcaaccagaaattagccgacctgtccatggttcctaatgccaggttgatcgacggcatcttgctcaccaagtttgatacaatcgacgataaggttggagcagctctttccatggtttacgtttccggagctccggtgatgtttgttggttgtggtcaatcgtatacagaccttaagaagctcaacatcaagtccatcgtcaaaactcttttaaagtgaatgtagttctttgctctctctctctctcatgactgtttgctactcctgc

SEQ ID NO: 69 - DNA, 1429 bp, Musa acuminata
atggagagcagcagcatatgaggtgggagaaccttcttcttcttacaccatatcatataatgaagccttattctccagagcttcagaatgggagcagcagaacaagcctgcagaacacccctaggatagtcctcctcctcactgccaccttgttcctcctcaccatcattcctctctatctcttccctttgctagccacatcgttcgcatggagaaacttgtccactccaccttcctccccttctccttctctttcttcttcctcttcatcttcttcttctcgtgacatgagccgtgacgccatggctggtgtgacgatggccaagagctcgtgtgatatctttaggggggagtgggtgcccaaccctaacgcgccttactacaccaacgagacgtgctgggccatccatgagcaccagaactgcatgaagtttgggaggccggacacggagttcctgaagtggaggtggaagccgaacgactgcgatctgcccatctttaacccggcgcagttcttggagctcgtcagagggaagtctctggccttcgttggagactcggtggggaggaaccaaatgcaatccctcatctgcctcctgctcagagtcacatatgcggtggatgcgtcggtcactgaagatgagaagttccggcggtatcacttcccgacccacaacttcacggtggccagcttctggtctccgttcctggtgagggcacacgaagccgaccccaatggcccaaccctcaccggcctcttcaacctccacctggaccaagtggacaccaactggaccacccagatgacgccgttcgactacgtcatcgtctccgccggccactggttcttccgccccaccatgttcttcgaggccgaccagctcgtcggctgccactactgcctccaccccaacgtcaccgacctgaccatgtactacagctaccggagggccttcagggccgcgctccgggccttcaacgacctcccgggcttcaggggcacggtgttcctccggaccttcgcgccgtcgcacttcgagaacggcgagtggaacaaggggggcaactgcgtgcggcagcggccgttccggggcaacgagacaaggatggacggctacaacctggagatgtacatggcgcagctggaggagtaccgggcggcggagggcgaggggaaggagaagggcgtcaggttccggttgctggacaccacggaggcgatgctactaaggccggacggtcacccgggccggttcggccaccgccccgacgagaacgtgactctctacaatgactgcgtccactggtgcttgccggggccgatcgacgcctggaacgatttcctgctccacatgctgaagaacgacggtggcagatcagccgccggccgacgatccaggagcgacaggaagtccacgatcaaatagta

SEQ ID NO: 70 - DNA, 843 bp, Musa acuminata
gagagcacaaggtttaagagaatggatctttctggtcaagaaggagagatcccaatcccaataaccagtgtatatgttggtggtcatggccatggcagcatccatgacagccctcccatccaccacccctccaatggccctcctcctcctcccctatccactgccaccacagaggaccaccaccacgacaccaccaactcctacagcaccaagaaaggggtggtagtaaggtacagggagtgcctcaagaaccatgcagcttccatcggtgggaatgccactgatgggtgcggtgaattcatgcccagtggcgaggagggaactctggaggccttgaagtgctctgcctgcagctgccacaggaacttccacaggaaagagacagaaggagagccctgctgcgactggttctaccccctcagggggaggaaggtgatgggccacaagggcctcctcatctcaggatcagatgcatttggttacagccctgcatgcaatagcctcattccaagggccacacctcacaacatgatcatgcctctgggtgtcatgcagacctctgagtctgatgagatggaaggggtgggtgcaatgatggcaaggcctgtcgtggtgaagaagaggttcaggaccaagttcaccccagagcagaaggagaagatgctgagctttgctgagaaggtggggtggaggctgcagaagcaggaggagagtgtggtccagcagttctgccaggagattggggtgaagaggagggtcctcaaggtgtggatgcacaacaacaagcatcacttggcaaagaagaactctctccagcttgaatgaccactgaaatcctcttgc

SEQ ID NO: 71 - DNA, 1203 bp, Musa acuminata
atggctagacttggaggtgaggcaacgttgacatcccgcctactcttcttcttcttgctatcgacggcggtgatgggtggcagcgcgacggtggagacaaggagaagtgtgctggggaatggcctcggcagaactcctcccatggggtggaacagctggaaccatttccactgcaacatcaacgagcggctcatcagagagactgctgatgcattggtgcatactggacttgcagggctgggttatcgctacgttaacatagatgattgctggggagaagccaatagagactaccagggaaatttagttgctaagcgatcaacatttccttccggcataaagtctcttgcagattacgtgcatgcaaaagggctgaagcttggaatctatagtgatgcagggtcacagacatgcagcagaactatgcctgggtccctcggatatgaacaacatgatgcaacgacgtttgcctcctggggggttgattacttgaagtatgacaactgcaacaaccctggtaccaggccaagagaaaggtatgccaagatgagctacgctcttcggaattctggaaggaacattttcttctccctttgcgagtggggtgtagataacccagcaacctgggcgagcggtctaggcaacagttggaggacgacaggcgacatctacgatagctggggcagcatgacatcgcgcgccgatgagaacaacagatgggcatcctatgccgggcctggtggttggaatgatccagacatgctggaagtaggaaatggtggcatgtcaacggaggagtatcgatcgcattttagtatatgggcattggtcaaggctcctttgttgattggatgtgatgtgaggacgattagcggagatgcattggagatactgagcaactcagaggtcattgcggtcaatcaagactaccttggagttcaggggaagaaggtattcggaggaggcagcgaagaggtttgggcaggtcggttgagtggagggaaggtggctgtggtcctctggaacagaggaagctcgcgggcgacgatcacagcgagatggtccgacatcggcctctcgtcctccaccgtcgtcagtgttcgtgatctttgggcgcgtgcgaccatcgggtctgttcgagggcagctcgctgcgacggtggctcctcatgcgtgcaagatgtacgttctgacgccgcggtag

SEQ ID NO: 72 - DNA, 809 bp, Musa acuminata
gttccgaatttgagaggatggaaggggtttttgctgactgctacgccagtagcattatatcccaaaatgcgattactgattcctctccaggctcatgtgacttttttgcatccaggcaatctgtgatgtcagcacttctcttggacattgcatggttaatgaaggcacctcatttggaagataaggaagcttttcggagtctaacaaacgtccagagattaacttctttgctaaaattcttactacagaatgagctttttagtgttcttcaagtaataatgcatcatctggatagtattgttgatgtcgatggctttgataagctagacaaatggactgatgttgaccaaaagctatttcacgagtaccttaaccatgcaagagagattctttatgagagaacacatgacatgagatcagaagcagaaatgagaaatccaatctgtggacttgtgccacaaagctctcagagtaatatgtgtggggagatttatacaaagcaaggaaatgaagcaattaaagattgcttattcttagtctcatttcagccggctgtggagcatgatgtaaatgttctgcttgtgaacgaagagatctcccacaggcagcactgtcaccataatctgggcaagaaatgtgcttttgacgatattttctcaaacaagatcacgaggactcgctttcctttgtttgtaatagttaccgttgttttgtgtttagcagcatgtatcatcctcctccacccacacgaggtgggggagattgcagtttccattagaaggtgcatgtttggtggctcccctgcatga

SEQ ID NO: 73 - DNA, 1587 bp, Musa acuminata
taggaagcctgctgaagccagacgaagaagagagagatgaggaaggagagcttggccttgttggcgaccctcgtgctgctgctgccaaccgcggaatccaacctcagcagggatgacttccctccgggcttcatctttggagcaggaacttcggcttaccaggtggagggtgctgctgctgaggatggtaggactccaagtatatgggatacgtatactcgtgcagggggaatgctggacaatagcacaggagatgtgacttccgatcaataccacaaatataaggaagacgtgaagctaatggttgatacaggactcgactcctacagattctccatctcttggtcgaggcttctaccgaatggaagaggagccattaatccgaaaggcttggcttactacaacaatctcatcgatgagctactgagatatggaataacgccacatgtgacaatctatcattatgatcttccacaagtacttgaagacgagtacgaaggatggctgagccataaaattgtggaggacttcacagcatttgccgatgtctgcttcagagaattcggcgatagggtgtctcagtggaccaccatcgtcgaacctaatgtaatggcgatagggtcattcgacaatgcaatatttccacctggccgatgttctaatcctttcggcttattcaattgcaccgtcggtgactccaccaccgagccgtatactgcagttcacaacttcttattggcgcatgcatctgttgtctcattgtacagaacaaagtatcaagccaaacaaaatgggaggataggcttgaatgtgtactccatgtggtgttatccatcgacgaactcaacattagacttgcaagcaacccaaagattattggacttcttcgtcggctggatcataaatcccctggtttttggagactacccaaaggtcatgaagaagattgtccgctcgaggctcccttccttcacggaggagcaatcggagcaactaaagggttcattcgacttcatcggcctgaatcattattcgtcgatctgggtcaaggacaactccgatgcctccgagactgcacctcgtgatttcaacgcagatctctttgccaaattcgctttttcaaagaacgatacaccaggcagtgagttagtccctactgacatacccttcgatcctgctggcctgcaacatctgttggagtacatcagagacgcttatggaaatcctccggtttatatcgaagaaaatggttatgggcttggattaaatggcacaatctccgacgtcaagagggcgaactacttgagtggttacattggcagcacgctcgatggtattaggaagggagccaatgtgaaaggatactacgtgtggtcatttctagatgtcttcgagttcttgtctgggtttcagtcaccattcggactataccatgtggatttcaaagatgaaaaccgcagaagacaacctaagctctctgcactttggtactccgacttcctcaagaagaagaagaagaagactagcacgaatataaacatgatgggactgcatcaaagatctcactctcaacggtgactcatgtga

SEQ ID NO: 74 - DNA, 1317 bp, Zea mays
gagctccaactctaaaagcatccgtcccttggcagcagcaacaagctactagctatgtgtgtttagagcgagcgagggaaaaaagaaaacatctaagatatactccaacatcttcgtttgattaacccgcccagtaaagccatgggtactaattatagagcggtcatttctctagtactcctcgtgtgcatcgctagccgctcgtccttgggtgccgctgaaactgacgttgagcagaagcgctcgtcagtccctttgatgtttgtgttcggtgattcgctggtcgatgtcggaaacaataacttcctgccgccgcctgcaccccgtgctgcatctccgtacggcatcgacttcccttctggcacccccggcgccgtctcaggacggttcacgaatggctacaaccttgccgatttagtcgcgcgacgtctggggttcaagatgagtccacctgcttacctctcgttgacaccggtatcaaagtttgacctgttcacgtgccgaattggtgccaattacgcgtctggtggatctggcattctcaacaccacgggaaacgggacactcacgctgcaaaaacaaatcacgctgttctcgaaaactaaagcaagaatgtcgtggggccgctgcaagctcagctctatggtatcgaggtccttgttccttatcagcgccggcggcaatgacttctccgccttcagtgaaatgggcatgggcgaacaagacgccccagcctacatcagtagcatggtctcaacctatgtccagcatatcgacgcgttgtacaagttgggagcacggaggttggggatcctagacgtgccagcgatcggctgtaccccaggctccagagtccccatggccaacggcggatgcaacgacgctgccaactctatggcgcagaacttcaacaaactcctaaggctcgaggtggcgaaagccgtcgcatcctccatgcccggcatgagatactccattgcaagcacctacaattttgtcaccgacttgatggacagccatctagtggctgggctccgggtggtcgacagggcatgctgcggatcgggaaaactgaacgccgcggtcatgtgcgcccagccaaacacgacttactgttcggatcgcgacgactacatgttctgggacatgctacatcctacgcaggcaacaaatgaacgtggggtggtcgccatcttctacggcccgcaggagtacgcggatcccatcaactttgcacagttggccgctgccacagcaaatgatgatggtgatataaatactgctatgaccgcaggcgtctatgccgccatatgatga

SEQ ID NO: 75 - DNA, 1901 bp, Triticum aestivum
ctcctcaaggccatagctagctagctccactatacagaccaccgagggcgcatggcgctgacgagtcacctcctggtcgtcctcctcggcatcgcagtgccgctgctcttcttctcccgtgcagaggggggcgaggtaggcgtgtgctatgggaggatggcgactaacctgcctgacccggcgaccgtggtgcaactgctcaagaagaacagcatcaccatggtgaggatctacgacaccgacccgacggtgctgcgctcgctggccaacaccggcatcaaggtcacggtggagctaaccaacgaggagctgccctccgctgccacggaccaaaatttcgctgatcaatgggtgcagaacaatgtcaaggcgtactaccctgccacactgatcaatggcgtgacgatcgggaacgaggtcttcaaagaggctagtcagttgaactctcagctcgtcccggccatgacgaaggtgcaagcggcgctggctcgcctgggcctggcggacgccgtgaaggtgaccacgcccatcgcgttcgacgcgctcaagatgtcattcccgccgtctgagggcgcgttccgtgacgacatcgcgttgttggtgatgagccccatggtcaacttcttgcaggaaaccgggtcgtacctcatgatgaatatctacccgtaccttgcgtacctgagtactccgggcatgtccatcgactatctcttgttccgccccaacgttggcgttgttgacaagaatagcaagcaaacgtacttcagcctcctcgacgcgcagcttgacgctgtgtactatgcgatggagaagctgccgtcctccagcctgcgtgctggggggatgaggaagctcacagcagggggcggaatactggaggtgaagcttggtgagagtcaccacccaaccagaggccaccatggcgtgggaacaagagccaacgcccaagcgttcaccgatggtctcatgagcaaagtgcgtggcggtaactccggcaccacctcaaacaaatataaccggctcgccaccagtgctgtcggcaccccgcaccgtcccaacgccgatcttgacgtgtacatcttcgaactcttcaatgaggacaacaagcccgaagacgagcaggacttcgggttgttctacccaaaccagcagcccgtgtaccaagtcgacttcgtccatggtgccggccccgtgcaaccgagctactgcaccgcgaaggccacagccggggacgcggccctgcaggcggcgctggactacgcgtgcggccacggggcggactgcagcgccatccagccaggcaagccctgctacaagcccaacaccaagcttgcgcacgcgtcgtacgccttcaatgactactaccagaagaacggccgggccagcagcgcgtgcgacttcggcggtgccggcaccattgtcaaccaggcaccatcaggccgctgcgaccttagcccgagctggtgtgtcgcgaacgcagcggtgggcgccgcacggctgcagaacgcgctggactacgcctgcggtcatggcgcggactgcactgacatccaacctggagcacggtgcttcgatcccgacaccaaggtcgcccatgcgtccttcgcgttcaatgactattaccagcgccataaccaggccgccggaacgtgcgacttcgccggtgccggtaccattgtccggcaggcaccaaagataggcaactgcgtgctgccgtcaagggcctgaactgaagaaactgtagccaaagcgaagctttactaccacgagattaagcaataatcccgacagattattgtctgctgccggcaaagtctagttttcaaatgtaaaactgcatgcttttcatcaggtgcttagagcaagtacaataatgggcttatagcctggttacgtgtcac

SEQ ID NO: 76 - DNA, 769 bp, Triticum aestivum
cttccttcttccagcaatggcggctttgaccggggcagcgctcctcctcgccagcctccttgctctcgcagccatcaccagcggcaacaccgaaggtgacatcctctactcgcaaaggcaggcgtggaaggaccccaacaacgtgctgcagagctgggatccgacgcttgtcaacccctgcacttggtaccatgtcacctgcaacaacgttaactccgtcatccgagtggacttggggaatgcaggcctctcaggcgccctggttcctggactgggacgaatggtgaaccttcagtacctggagctgtttgggaacaacatcagtggaccgattccagcaaccctcggcaacctgacacgcctggtcagccttgatctctatgacaaccgtctcaccggcgcgataccagcctcgctcgggaacatcgagacgctgcgtttcctgaggctgcatgggaacaagcttgcaggtggaataccggcgtcgttgggccgtctgaagaagcttcaggccttggagctccaggaaaacatgctgagcggcacggtgccgcgggaggttctctcccttgttcttgtcggggacttgactgagcttaacgttgcaaagaacagtctggccggcactgtcaaatcttctaaaccaagagtagctactgtcatccaggacacgctcaagactacacgtctacacgctgagcagcactgacaacctgaacttttgtaagaataaactgaatgttttttccttctgaaactgctgggagag

SEQ ID NO: 77 - DNA, 341 bp, Triticum aestivum
agagatttgctccacaagttcaggaccaaccaacgatgaagaacagcacgcttgtggcgatcctggtcgtcctccaggccatcatggtcataggaatcctctcacacgccgccgatgacaatttccccaagtgctgcgaccactgcaactcctggtcggggtaccaattctgtgacgacgtcggccccaggtgccgcgacggctgcgtcaactgccacgtggtggagacgagccccgtgaagacgttccggtgtggagatggacgccccgtcctcggcgggcaaggcacgcccacgccctgcccaccaccgtgcaaaaagcattgatcgctagagctcaga

SEQ ID NO: 78 - DNA, 4290 bp, Oryza sativa
tcaaatcgataaacgtgagtgaatcggcccgggccacctcatgtggcacttgcgggggaggagctccgtgaccgcagcagcagccgcagcgctacataaaccggtcgcccacctgcgcctcctcctcgcagtctccgcctggtccgtccccgccgcagcctccaacgtcgcggcggcttcgactacgactcgaggcggcccgagccctagcgcgggcgtcgcgcctagagcgatgccttcctcgtcctcctcgccgccttccgccgccgaggggacgaccgctgcagcgggtgggttccgcctcaccgagccctcgttcctcgagtcgctgatgccgaagaaggagatcggcgtcgaccgcttcctcgccgcgcatcccgagtacgacggccgcggcgcgctcatcgccatcttcgattctggagttgatccggctgcagctggtttgcagactacttcagatggaaagcccaagatccttgatgttattgactgcacgggtagtggtgatgttgacacgtccaaagtggtgaaagctgatgatgatggttctattgttggtgcttcaggcacccatctgactataaatccctcatggaagaacccttctcaagagtggcatgttggctgtaaattagtctatgaactcttcacggacacacttacctctcgtttgaagaaagaaagaaagaagaaatgggacgagcacaaccaagaagcaatatctgaggccttgaaacagctgaatgaattcgaaaagaaacacagtaaatctgatgacgccaaacaaaaaatggctcgtgaagacctgcaaagcaggcttgagtacctgaggaaacaagcagaaggttacgatgacagggggccggtaattgatattgttgcatggcacgatggtgatgtgtggagggttgctgttgatacccagggccttgagggcaacaaaaattgtggaaaacttgcagattttgttccattgacaaactacagacttgagcggaagtttgggatttttagcaaattagatgcttgctcttttgtagcaaacatttacgatgatggaaaccttgttagtatagtaactgattgctctcctcatgctacccatgttgcgggcattgcagctgcttttcatcctgatgaacctttgctcaatggagttgcaccgggtgcacaactgatttcctgcaagattggcgatacccgtttaggatcaatggagacagggacaggcctggttagggccttgatagctgcagtagagcacaaatgtgatctgattaacatgagctatggagagcctacccttcttcctgactatggcagatttattgatcttgctagtgaggttgtagacaagcatcgtattatatttattagtagtgctggaaacaatggtcctgctttaaacactgtcggtgctcctggtggtactagttcaagcattattggcgttggcgcttatgtctcaccagctatggctgctggagctcactgtgtcgtacaagcaccagctgaggggatggagtacacatggtctagccgaggtcctactgctgacggggatcttggtgtctccattagtgcaccgggtggagcagtggctcctgtaccaacatggacacttcagtctcgcatgctcatgaatggaacttccatgtcatcaccttctgcctgcggtggggttgctcttcttgttagtgccatgaaggctgaaggcattccattaagcccttatactgtgaggaaggcaattgagaatacagctgcatcaataagtgatgtgcctgaggagaagctaaccacagggcatgggcttttgcaagttgatagggcttttgaatatgctcaacaggctaaggaattgccacttgtttcttatagaatatcaatcaatcaagtgggcaagccaacttctaaacttagaggaatatatctacgtgggagtaacacatgccggcaaacaagtgagtggactgttcaactagacccaaaatttcatgaggatgcaagtaacatggagcaattggttccatttgaggagtgcctgcagctgcattccactgatagctctgtcatcaaaattcctgagtacataatggtgacaaacaatgggcgcactttcaacattgttgtaaatcctgttaatatcagcagcggccttcactattatgaagtttatggtatagattgcaaagcaccatggcgtggacctattttccgcgtaccaatcactgtaataaagcctattgctctatcaggagagccacctgcattgacactttcaaatctttcctttaagtcaggtcacattgaaagaaggttcataaatgtgcctattggagcttcatgggtggaagttacaatgcgcacatcagcctttgatactcctaggaggttctttttggacactgttcagatctgtccactgaagcgacctattaaatgggaggctgttgtcactttctcttcaccttctctcaagaatttcagttttcctgtagaaggtggcttaactttggagttgtccatagcccagttctggtctagcggaattgctagccatgaacctacctgtgttgattttgagattgtgtttcatggaatatccgttgatcagaaaataattggccttgatggtagtgaggcacctgtgcgtgttgttgctagatctctattagcatcagagaggcttgttcctgttgccactctgaacaaggtcaagaccccttatcgaccagtggagtctaatctttgttcacttcctcccagccgtgatagattaccatctggcaagcaaatcatagcactaactctgacttacaaattcaaactagaggatggtgctgaaataaagccccgtgtgcccctacttaacaacagaatatatgataacaagttcgagtctcagtattatagaatatcagattcaaacaagtgtgtctactcttctggtgacgtctatcctaattatgtcaaactctcaaaaggtgaatacacgctgcaattgtacataaggcatgacaatgtgcagttattggagaaactgaagcagttggttctatttatcgagaggaagctagagaaaaaggatttcattcaattgagtttctactctgaacctgatggccctacagttggaaatggcaccttcaaatcctctattttagttccaggagaaccagaagcattctatgtgggtccaccatctagagaaaaacttccaaagaatgttctacctgggtctgttttggttgggtcaattacctatggtgcggtaagctctttcagcaagaaagatgaccaaaaccagcatgctccagcatcttatagtatctcgtatctcattccaccatcaaaggttgataatgataaagaaaagggagtttcatctggaagaaagagtatttcagagagattggatgacgaggttcgagacaccaagataaagttcctttctggctttaatcaagaaactgaggatgacaagtcttcttggacggcacttgttgcttctcttaagccagagtatcccaagtatacacctttgcttgccaaaattttggaatgcatagttcagaaagcaacttcagatgataagtttagccatcaaaaagagattatagctgcagctgatgaggttgtggacagtattgataaagaggatctggcaaagtctttgtcccttaaaccagatcctgaagatgaagaggcacagaaaaataagaaaaagatggaagaaacacgagaccagttggctgatgcactataccaaaagggtcttgcattggcagagattgagtcgctaaagactgatgagtcaactgaggcatctgctaaagatgtttttgaagagaattacaaagaattaattaaatgggttgatgccaaaactacaaaatacggctctttaactgtcctgcgtgagaggcgctgtggaagacttggcactgcattgaaggttctgaatgacatgattcaagatgactctgagcaaccaaagaaaagactttatgatttgaagatccaattgattgaggagataggatgggtccatgtatcggcctacgagaagcagtggatgcatgtccgatttcccccatctttgcctccgttttaattgttaggactatttttcactcatttttcatcaccatggattcagtattttactatttttgtcattgttggtagcaaacttgctggtttggtagtttttcactaggtattttatttcttcaaatggtaataagaacttaagaaggctgcctgctactgctaagctcatcg

SEQ ID NO: 79 - DNA, 2307 bp, Musa acuminata
tccccccctttccttcttcgttacccacagggtcaagggcggcgcactgatctacgctttgatagagctccccaggcggttctgcttgcatatcaaatgtcttttgacatcagaacggactatcctagttttatttggtgcgactttcggttcatatgccgtagtctgttgttttgttgtcgtagagcattatttcggcactggacttgataattcagagattttggctcggagctgaacttaatccaaaggtttccatttctgagccaacaaaggttttcgctgctgaggatacttttgagaagcacagttatactgttattgctgtttggctatatcaaattttaagtctcattatagtattatagacaagagatcgtgatggctaagaccaacctcccaccgggcttccgttttcaccccactgatgttgagcttgtttggtactacttgaagaggaaagtaatgggaaagcctttccggtctgaggctatttctgaagttgagctatacaaattcgccccttgggaactcccagaaaaatctcggttgcgcacaagggatcttgagtggtacttcttttgccatcgtgataaaaaatattcaaatggctctcgatcaaatcgagcaactgatggtggttattggaaggctactggaaaagacaaatctgtcattcacaactcttgtacggttggtatgagaaggactctagtttttcacgaggggaaaccaccaaaggggacaaggactaactgggtgatgtatgaataccgactacagagcagggaattggttgatgctggattcgcacaggacgcttacttactctgcaaagtattccaaaagagtggtctgggtcctagaattggggagcaatatggtgcgccatttaacgaagaggactgggaggatgacacggccattgagagttcctttcctcttccttgtgtatcttcttgcctgagtgcagaaccattagataaccaagctatacaggcggatccagttagcaaacagcctatagcttccagtgctgttgagttactttccgatcatgatcttcttgatgttgatggaatatcgttggaggagttggcagagtttcttaatagctctccactcgtagagaatgctgatggcaagatgcctgatttaaccattcctagcatgaatgttaatgaagctgcagctatggaccctgaaggagtatataatgaattagacgatctctctactggggaattgatttctggcaatatcgatctaattgaaaacattctcaatgaaactgccttgtgtcctacgctacaagaacttgatagtaaacagtatgttgagctgaatgatcttattggggatggaaatccctatgtgtctgtcgagccaagtactccatttgccccaaacccatctggtcattggcccgatttggagaatctgaatcacatccttgatccaatcccttactttgataatgatgtttatggtggcatgcatggtcttcctcatacaggacctgatacaacaagccaacattggttaccgggcatgcagattggagattttggtgaatttgtgcccccacttgaacgatcctctttctgagtatttatcatcacttgcaagaacactctccagctaaattcctgtggccccttttgtctatatgggtttcaagcatcaaaagccaagtgtttgttatagctatgggccaatatttactgaaaggacgatgtcaagaaaagaaaatggattcacactacttgtgagttctgccttagaagagatgctcatcagtaaattttgcagcgcttccctgatttgttttggttcttcaaccatagtacaacttatttcttactagtgtctctctctggaatctggtggaagttgaaacactgcaatttatttcgtggtatctatttcggtgttcaccagatttaccaaaagtgagtgtcactcagagcttctcatggctatagacaacacagctactgttcctatcaggcagtctatcatccttctcttccacgaaagccgcctctattctctttcggcttctcatggtgtattaccaaaagctgacattcgaacttcatgggggacggttgtctgccggcagcagcatttatttcagcatggatgttaatgggaagtcgcatgctacatctattttatgtacttattcgatgtttaatgatgcaacgcttggcaaagggagggggccaataattatagtgctggtttgtgtcctgaactgctacttgataataaaagacgtctattgtagaacatttaagtcga

SEQ ID NO: 80 - DNA, 964 bp, Musa acuminata
ttacctcacttgcctgccaccgaaccttccttgtctcctccattgacatttctactacgttcatccctcaatttgcgtgtggttttgaagaagatgtcgggcaaggactgcggcgaccacagcaagtggtggaagctccggaagcgcttctggcgcatcttagggtgcatcgtcggcttcataattctgatccttctcatcatcctcatcatctggctggtgctccgccccaccaagccccggttctacctgcagggcgcggtggtgctgcagttcaactacaccggcccacccagcaacctgctctccaccgtcttccaggtcaccatcgcctcccgcaaccccaacgaccgcatcggcatctactacgaccgcatcttcgtctacgccgcctacaagaaccagcagatcagcctcgccaccgccctgcccccgatgtaccagggccacaacgacgtcgtcatctggtcgccctacctcttcggccccaacgtcccggtggcgccctacctctgcgacgccctcacccaagacaaggcttccggcttcctcatcctccacgtcaagatcgacggccgcataagatggaaggtcggctcctggacctccgaccactaccacctcttcgtcagctgcccggccttcctcacctttcaaaacgggaggtcaggatccggcgccgccgtcaggttccagcagatgtccgcctgcagcgtcgaagtctaaggacgccgagctccagtctgtgtctttagcaggtttttttcttctctctttaggcttaattagccgtaacgcacgctgttccatgttatgtagcagaaggccaggctgtgtgatagacacattaaggggaggaggacgatgatgggagaaattaataatggtttataaattccaccaagatcaactgatgtatttgcaagccaaatgttgaatactaagcatcacatgtttatatata

SEQ ID NO: 81 - DNA, 1154 bp, Musa acuminata
gtactgtttagtgtagagatccaacctcaatgcctctttgtagaccatttaatttggtacggccccttcattgggaagaccgagtggtaatttttgctatgtattgcatgacttattctatgtaagatcgtaccccttatcatcaatcgaaggttcaccgcaccactaccttcttttcttccttatatattgactcgcttccctgctgccacgccttctctcttctcctgcatctctctctctctctctctccccatcagctggtgtgagtcttggataggaggaagaagaagatgacggccaaggactgcggtcagcacggggagtgttgcgagaggcggaagcgcaaccggcgcatcttcggatgcatcctcgctaccataattgtgatcctcctcatcatcctgatcgtctggctggcgctccgccccaccaagccccggttctacctgcaggacgcggtggtgctgcagttcaactacaccgggccgcccagcaacctgctctccaccgtcatccaggtgaccctctcctcccgcaaccccaacgaccgcgtcggcatctactacgaccgcctcgacgtctacgccgcctacaagtaccagcagatcagcgtcgcctccgcccttcccccgatgtaccagggccacaacgacatcgacgtctggtccccctacctctacggccccgacgtcccggtggcgccgtacctctgcgaccccctcacccaggacgagtcctccggcttcctcctcctccacgtcaagatcgacggccgcatccggtggaaggtcggctcctggatctccggccattaccacctcttcgtcagctgcccggccttcctcaccttccagaacggaagatcgggatccggcgccaccgtcaagttccagcagatgtcatcctgcagcgtcgaggtttaacaaggagcggcccaggcagagttgccgagctcctccactttccatctttagcttctctttttgggttagcgatgacgtactctgtttcatgtgatccagtaggcggccaggctgtgtgatatatatatatatatagggctgaaggaggagggagggcagaaataaaagaaagaccaatataaaatgatgtatttgcaaggcaattgtttatattaataatcttaatta

SEQ ID NO: 82 - DNA, 1299 bp, Musa acuminata
tggcgatgccatgttttggtagatacactaagaatgagttcgctgcgagcttcctcctccaaccttgtgtgggtggccgctttggtcgtgtcactcatggccttgtgtgaggcgcagctctcgcctaactactacgacaagacctgcccacaggtgctgccaaccgtcaagaaagccaccggtacggcgatcgctcgagagcatcgcatggccgcgtccctcctccgcctccatttccatgactgctttgttcagggttgtgacgcgtccatcttgctgaacgatgcggcgggcatcgtgagcgagaagaacgcacgtcaaaacttcagatctgcgagaggatacgaagtgatcgacggcataaagtcggccgtggagaaggtgtgtccgggcgtcgtgtcctgtgctgatatccttgccatcgttgcacgagactcctccgtatacgtgggtgggccttcatggaaggtgaagctcggaagaagagactccaccaccgccagcaaagatctggcagagcaaaacctgccaatagccttcgacgacctcgacacgctcacctccgtgttcgcgcggcaaggactcagcctcaaagacatggtcgtcctctcaggatcgcacaccatcgggctggctcagtgcgccaccttccgggggaggatatacaacgagacgaacatcgacgcgggattcgccaggatgcggcagcgccggtgccctccgaccgccggcaacggtgacaccaacctggccccgcttgacctggtcacccccggctccttcgacaacaactactacaagaacctgctgagaaagaagggcctgctgcactcggaccagctcctcttcaacggcgggtctaccgacgccacggtggcggcgtacagcaaggaccaggcggctttcttcgccgacttcgcggctgccatggtgaagatgggcgacatcagccccctcactggctccgccggggaggtcaggaaggtctgcagcgtggtgaactaagcgctgttatcctctctctctctctctctctctctcactctgtgtgtgtgtgtgtgtgtgtgtgtgtacgtcagatgcgtccaaatgggatggactgtgtcttatacgttgtcggtgtttggattgcctcgctatcgacgtttcggtcgatgcaatgcaaatggtttcttcgcgaagcccatatgtttgctatcaataatgaagtccacgttgatctaaagaacacgtaatctattgattgtattgtattcgattaattaatctattttattcaacacatagtcaaattgctca

SEQ ID NO: 83 - DNA, 1506 bp, Musa acuminata
tgtcaaacaccatccagtgttcatcacccatgtctccaatgaaataacttctcctctcccggctcccaataaaacgccagcaatggccctctcctttcaactcctggacctttctttcctcctcacccaaggaacataagatacagctcttgcctccacgataagataaaccaccgagacggaaagagacagctagagaaagcgagcaaggtagtttaaggctgagaggggaagagcagagcagagagatgatcttgagagtagaagtgatggcttcttcttcttcttcttcttcctcgtccttcttcctcctcttgttgggtgttgcgctgttcctctccaatgaggctactgctctcccagaactgcccaacctcaccaccctcgcttttgaggaaggctatacacagctatttggagactccaatctcatgcttcatcgcgatggcaggagcgtccacctctccctcgaccggcggaccggtgctggatttgcgtcacaagacctctatcgccatggattcttcagtgcctccatcaaactgcctgcagattacgctgccggagtcgttgttgccttttatatgtcgaacggagatgtattcgagaagacacacgatgaattggatttcgaattcttggggaatataagaggcagggagtggagggttcagacaaatgtttatgggaacgggagcaccgcggttggtagggaagagagatacgggctctggttcgatcccacagaggactaccatcagtactccatactgtggagcggtgaaaggatcatattttacattgacgacatccccatcagggaggtggtgcggacccaagccatgggcggggacttcccctcgaagcccatgtccctctatgccaccatatgggatggctccacttgggccacctcgggcggccgctacaaggtcaactacaaatatgccccttacgaagccgagttcgccgaccttgtgctccatggctgcgccgtcgatccgattgaacacagaaccacctgtctgggatacgacgccgcagtctacgattccatcacaatgtcagcagatcaacggacggcgatggacaagttccgaaagaagcacatcacctactcgtactgtcatgatcgcgttcgttatccgacaccaccaccggagtgtaatctcggtcctgaagccgaggatttccttgcatcaggcgaggcaaagttgagctatcgccgccgccgcggtaagcgctacggccgcagcccggtggactcagttctctgagtcccagtggtttggatatcgaataagtggttcaggtactgcgaggggaatttattttttgtgtaccatctactctactattctggtgttgtatagcaaatttgaattgacgtcggatagattagattcacatttgtttaggtgacatgcatatgtataacctagtctgtccaagcttgttttggagtctcgtcttgctcaacagtggttcccgccctttctagtttcc

SEQ ID NO: 84 - DNA, 1158 bp, Musa acuminata
cactgagacagagagacagccagagaaagagagcaaagccagcttaaggtgaaaaggagaagagcagagcagagacaacaatcttacagaagagatggcttcttcttcttcttcttcttcttcttcttctgctttattcttctactacctcctcctgttgggttcagcactgttcctcaccaatgaggctactgctctcccagaagtgcccaacctcaccaccctctcttttgaggaaggctacacacagctatttggagactccaacctcattcttcatcaagatggccagaccgtccacctctccctcgaccagcggactggtgctggatttgcgtcacaaggtctttatctccatggattcttcagtgcctccatcaaactgcctgcagactacgctgctggagtcgttgttgccttctatatgtctaatggagatgtattcgagaagacacatgatgaattggacttcgagttcctggggaacataagaggcagggaatggagggttcagaccaacgtttatgggaatgggagcacagcagttggtagggaagagagatatgggctctggttcgatcctacagaggactatcaccaatactccatcctgtggagcaatgagaggatcatattttacattgacaacacccccatcagggaggtggtgaggacccaaaccatgggtggtgacttcccttcaaagcccatgtcactctatgccacaatatgggacggctccacctgggccacttcgggcggccgctacaaggtcaactacaaattcgccccttacgtcgccgagttcactgaccttgtcctccatggctgcgtcgttgatcccagtaaccataacagaacctgcctggaatctaatgctggagtttacaatgctatgatgatatcaacggatcaacgggcggcgatggagaggttccgaaagaaacacatgacctactcttactgtcatgatcgcatccgttacctgacaccttctccggagtgttctctcggtcccgagaccaagagtttcctcataacaggcgaagcaaggtccagttaccaccaccaccatggtaagcgcaatggccgcagcacagtagatgtagccctttgagtctaagtagttattttttttgtgtcccatgtattccaagt

SEQ ID NO: 85 - DNA, 997 bp, Musa acuminata
aatccctaattctctctctatctccatctctgaccacctctttccctatattacaacccagcccggagaccctcttcctcccatagccaggctgctgcctcctcccactcccgtacccttttaatcctccgcgaaatcctattcttctcctcccctcctcccttggaatcggccacgcggttcaaggcaccgatttggtgttcgccttgttctcacataacaagattgaccggccgagcgattgatctggaaagaaaggggagggaggagaatggcggaagagcagcgatgccaggagggccaccgcctctgcgcgaacaactgtggcttcttcgggagccccgcgacgctcaacctctgctctaaatgctaccgcgatcaccgcctcaaggaggagcaggagcgacagcagcagccggcctcttcttccgccgcctcggcgatgctcaccgtcgcgaaatccttccctgcctcttccccagccgtcgtcgtggttgacgaggaggtgagcggcgcctctgtcccggccgccccgccggaggagacggagaagaagaagagcgcggcggaggggccgagccggtgcgcgaggtgccgcaagagggtggggctgacggggttccagtgccggtgcggggccacctactgcggcgtccatcggtacgccgagcaacacgactgcacgttcgacttcaaggcggccggccgcgcggccatcgcccgcgccaaccccgtcgtgaaggccgacaagctccacaagatctgaagaatctccaccctccgtctcccccttcccccggctcgatggacggccccgatctcgtcccggaggagaccccactcccttgtgatatgatgatgattgacggctttctggtggattgctttctccatttctttttttcttttttctttttaggttcgggtggtggttaaaaaaaagcctggaaaatgtaaactattattaattagtagttcccacttatttctcttttaa

SEQ ID NO: 86 - DNA, 1492 bp, Musa acuminata
catttaaacgaaggagaagaaaaggaaaggagaggagaggagaggaaagagaagaaggcaacctcgactcaaatccaaccacttgactgtgactcgcccttcctcttcttttttagcttggcccttcacttgattccgacgcctccttcggtgttgccgacacttccgctggcaggcctttgttcctggtaggaatggggaggcaatcatgctgctacaagcagaagctgaggaaaggcctgtggtctcctgaggaagatgagaagctgatcaggcatataaccaagtatggccatggatgctggagttcagttcctaaacaagcaggtcttgagaggtgcggaaagagctgcaggttgaggtggataaactacctgaggcctgatctcaagagagggacgttctcaaagcaggaggagagtctcataattgaactccatgcagtgctcgggaacagatggtcacagattgcatcacgtttgccaggaaggaccgacaacgagatcaagaacttctggaactcctgcgtcaagaagaagctcaggcagagtggcatcgaccccaacactcacaagccgctcgcagagatggaagacaagacctctaactccggtgatctcaaagcccccgccacaaccttggagaaaaccaagcattcggtacacaagccggcatcatcatcatcatcatcaggcgagagcagaacatggaagaattcggtgacgccgaccagaggcttcttccacgaccacgagagctcatcggcctgccacttatcccctcttccacactcaggctttgcccctgactgcgctcctctcttcgaaatgaaccaggagttaaattgcagcacgatatccacagttctgctatcggttcccagcggaaacatctcagctttgatgagcctgaaaccaaatatcgatcttttccgtgatgaaattgatggtattcagtgcagcagtgatgtttatttgagtaacagtcgccggagcagcatgaacactggtagcgtaatcgagttgcaaagcagcacctccttcgacggtggcatcctccctttctcggagctgacgccagaaaagaacgcccacgtccagctcgaacgggaacacgaggacctcaaatggtcagagtaccttcaaggaaccattacggcatcggcaacaatccaaagccaaagtcatcctctgcaatatgacatcaagaccgaaagccaatctgtactcgttggtctgggcacttggcagcagaatcagcaaggacagcagcagttgcagtcctcaaacatctacggtaaggatttccatatggtatctgtaggtttcggacaggtttaaatcgagtcaagaaaggtagagatagcgactctcttccaactcttagagctcctctgtgtaatgggtgtatagacatgatgttcaagagtgataagccaaagcttgttctggttgaagttccacacttgtgcaaattgagttttcctctttca

SEQ ID NO: 87 - DNA, 2173 bp, Musa acuminata
tttcctctcccctttgcgcctcctattctcttccatttctacgttcgttgcttgttttctagggtttcccaatcaaatccacacgcaaatttaggattcatatcctttttttttttctttggtgttttcgtggggttttggttctttgggtttgttcagatcggatccgaggatgttggagcagctgctgatcttcacgcggggcgggctgatcctgtgggagctcggcaacgcgctcaagggatccccgatcgacgccctcatccgctcctgcctcctcgaggagcgctccgcggacgctgccttccattacgacgcccccgccggatgcgccgcgtacaccctgaagtgggccttcgacaacgacctcggcctcgtcttcgtcgccgtctaccagcgtatcctccacctcctctacgtcgacgacctcctcgccgctgcccgccgcgagttctctcgggtctacgagcccaagcggacctcctacgatgatttcgacgagaccttccgccagctccagaaggaggccgaggcccgggccgaggagatgcgcaggttcaagcaggccggccgtgcccccgcggcgcctggcaagaagcaagttcccggcgccgcttccaggggttccgggaagcaacggagtagtggtggtggcggttcggggaaagatgagtccgacggttatccaggaaaaggtcgtcggtcagagaatggtagttctaatgggcatgagaatgaaataaagccgaattctcgcgcccagaatgtagtagtacacggaaaagagaacggagcccctcgagttgatgctttcgatgtaagtaagctacagaagttgcgatccaaaggtgctaagaagacggatactggtggtggtggctgtaaggctgccaaggcagagccgaaaaagattgcaaagaagaacagagtttgggacgattcgccttccgagtcgagactggatttcacagatccagtggctgatagaggcgaagggcctgaggttgtggtagcagatcagggagagagcatgatggataaggaggaaattgtgagcagcgatagtgagggtgaggaggatgaggaagtagggaatgagaaacctggcacgaagaagaaggggtggttttcgtctatgctccagagcatttcaggtaatgctgtgttagagaaatccgacttgagaccagcactgaaagctctcaaggataggttgatgaccaaaaatgtggctgaggagattgctgagaagctttgcgaatcagtggcaacaagtcttgaagggaaaaaattgggctcctttacaagagtgtcttcaacagtccagacagctatggaggaggcgctccttcgcattttaactccaaaacgatccatcgacattctacgagatgtccatgctgccaaggagcaaggaagaccttatgttgttgtttttgttggtgtcaatggagttggaaaatctaccaatcttgccaaagttgcttactggcttttgcaacataaaattaatgtcatgctggcagcatgtgatacattcaggtcaggtgctgttgaacagcttcgcacgcatgcacgcagactccaaatacctatttttgagaaaggctatgagaaagatcctgcaattgtagcaaatgaagctatccaggaagctaaacgcaacaattcagatgttgttcttgttgacacagctggtcgaatgcaggataatgagccactcatgagagcactctccaagctcatcaatctcaacaacccagatctagttctttttgttggagaggctttggttggaaacgatgctgtggatcaactgacaaagtttaaccagaaattagccgacctgtccatggttcctaatgccaggttgatcgacggcatcttgctcaccaagtttgatacaatcgacgataaggttggagcagctctttccatggtttacgtttccggagctccggtgatgtttgttggttgtggtcaatcgtatacagaccttaagaagctcaacatcaagtccattgtcaaaactcttttaaagtgaatgtagttctttgctctctctctcattagtgtttgctactcctgctttgactttaatcccctgtgacctcattttcttggcactggaagcaaataaatcataatggcttggtttggatttatgatgtta

SEQ ID NO: 88 - DNA, 2373 bp, Phoenix dactylifera
cagctcctataaataaccccaccgaaaaaagatgcgtcgaactcgtctccaccccctttctcgaccatcctccctccctctctctttctcttaatttttttttaatttttccaaggtttcttcagcaatccgcaaagcaagctcggtattctctctttcgatcccttctccaatccccgatctcgagacaaaaaaaaaaaggaattcgagatgttggagcagctgctgatcttcacgcggggcgggctgatcctgtggacctaccgggagctcggtaacgcccttaagggctcccccgtcgacgccctcattcgctcctgcctcctcgaggagcgctccgccgagacctccttcagctacgaagcccccgccgggggcggctcctacaccctcaagtgggccttccacaacgaccttggcctcgtcttcgtcgccatctaccagcggatcctccacctcctctacgtcgacgacctcctcgccgccgtccgccgcgagttctcgcagatatacgaccccaagcgcacggcgtacgatgagttcgatgagatcttccggcagctacaaaaggaggccgaggctcgcgccgaggagatgaggaagtcgaagcagtttaatcgggcccctctcgtcgctggaaagaagcagagaccgggccagagggctgggtcgcagggaaacgggaagcagaaaggcggtaaagttggttctggtaaagatgatgctgatggtgagtcgggaaaagggcgtggattatcaaacgggagttcgaacgggcaggagaatggaatcaaggagccttctcgtgccccgagtgttcttgttaagggaaaagagaacggagcccccgaagtgggggctttcgatgtaaataagctacagaagttacgccccaaaggtgggaagaagacggatgcaggtggtggtggtgggaaggcttcgaaggcggagtcaaagaagatggtgaagaaaaatagggtttgggatgattcacctcccgagtcgaggctggattttacagatccagcagatgagaaaggggacagcatcgtagatgttgtggcaacagatcagggggagagcatgatggacaaggaggaaatagtgagcagtgagagcgagagcgaggaagatgagggagtggagagtgccaaacctggcaccaagaagaagggatggttctcatcaatgtttcagagcattgcaggtaatgctgttttggagaagtcggacttgacaccagcattgaaagctcttaaggataggttgatgactaaaaacgtggcagaggaaatagctgagaagctttgtgaatcagtagcagctagtcttgaagggaaaaagctgggatcattcacgagagtttcctcaactgtccagacggcaatggaggaggctcttcttcgcattttaactccaaaacgatccattgacattttgagagatgtacatgctgctaaagagcaagggaagccatatgttgtagtttttgttggtgttaatggagttgggaaatctaccaatctcgccaaggttgcatactggctcctccagcataatatcagtgtcatgatggcagcatgtgacacatttaggtcaggtgctgttgagcagctccgtacgcatgcacgcagactccagatacctatatttgagaaaggttatgaaaaagacccagcaattgtagcaagagaagctattcaggatgctagtcgtcatagttcagatgttgttcttgttgatacagctggccggatgcaggacaatgaaccactgatgagggcactctccaagctcatcaatctcaacaacccagatttagttctttttgttggagaagcattggttggaaatgatgcagtcgatcaactatcaaagtttaatcagaaattagcagacctatcaacagttcctaatgctaggttgattgatggcatcctgcttaccaagttcgatacaatcgatgataaggttggtgcagccctttccatggtttacatttctggagctcctgtaatgtttgttggctgtggtcagtcctatacggacctcaagaagctcaacgtcaagtccattgtcaaaactcttctgaagtgaatgctgttccgcatactctcacatgactggctgttgtttctttgcaaacttaagtcccccatgacctcatcatattgactttggaagtggaatcaatctgcttttgtttaaatccatatcatcaatttatcttttggtatatgccgtctctgtttatttttcgctcttttcgatcagatgtgtgccaaaacgaaatgaatctgttgttgataaatgcataggcatatgctacatatagtaaatggcagggagaggactatatctgcattatggata

SEQ ID NO: 89 - DNA, 2795 bp, Cocos nucifera
aagtagccttagagactaccaattttgcatttggcaccctcaaccctggcggttaagttctcccctctcgggttatacagttggccggacggtggtgtttcgggcttgggctgaccagggcggtccccttggctcgatcagaacggtccagatcagtgccacggtccgacacaaccgcgcccatgctggtccgaccaatctgtccagttcctttctcgtcatacggttggcgcgacggtggtgtttcgggcttggcttgactggggggtgattacatcatgttccaggtccgcttggttcggtcgggccggcccagaacagtcccacggtctgagtcaaccagcctgtgacccggccaaccttgcatcccccctggcggccaccctcccggtggcttgccgaccccaacagccgttgccttcaacggtttcggtccccctcgcacccccaatgcaataaatatcccaacgcaaagaatacgcgttgaaccgtcgcctccctcttctccaccttcctccctctttctattttcttatcggttattttttctaggttttcttctaggcggaactcaatctaggtatcattcgtttctctcaatccctgttgtcaagaaatcagggtggttctaagtcatctaatcccttcgatctccctttcttttcgtcgatttctattagaagtttccagttcttggatcgtggatcctcgatctgatcgagtttggaggagagatgttggagcagctgctgatcttcacccggggcgggttgatcctgtggacgtgcggcaacgccctcaagggctccccgatcgacgccctcatccgctcctgcctcctcgaggagcgctccgccgagaccttcttcagttacgacgcccccgccggcggcgccgcctacaacctcaagtgggccttccataacgaccttggtctcgtcttcgtcgctgtctaccagcggattctccacctcctctatgtcgacgatctccttgccgccgtccgtagagagttctcgcagatttacgaccccaagcgcacggcgtacgatgaattcgatgagatcttcaggcagctgcagaaggaggccgaggctcgcgccgaggagatgaggaagtcgaagcagtctaatcgggcccctctcatggctggaaagaagcagggggccggcgccggccagagggcggggtcgcagggaaacgcgaagcagaaaggcggtaaaggtagttctggtaaagatgatggtgatggtgagttgggcaaagggcgtgggttatcgaacgggcaggagaatggaaccaaggagcattctcgtgccccgagtgttgttgtcaagggaaaagaaaacggagcccccgtttcgggggctttcgatgtaaataagttacagaagctgcgcccaaaaggtgggaagaaaacagatactggtactgggaaggcttccaaggcggagccaaagaagatagtaaaaaagaatagggtttgggatgattcaccttccgattcgaagctggatttcacggatccagcagatgagaaaggggatgaggtcgtagattttggaaaggcagatcatggagaaagcatgatggacaaggaggaaattgtgaacagcgagagtgagagcgaggaagatgaggaagtggagagtgccaagcctggcaccaagaagaaggggtggttctcatcaatgtttcagagcattgcaggtaatgctgttttggataaggcagatttgaaaccagcattgaaagctcttaaggataggttgatgactaaaaatgtggcagaggaaatagctgagaagctttgtgaatcagtagcagctagtcttgaagggaaaaagctgggatctttcactagagtttcatcaactgtccagacggcgatggaggaggctcttcttcgtattttgactccgaaacggtccattgacattctgagagatgtacatgctgctaaagagcaagggaaaccatatgttgtcgtttttgttggtgtcaatggagttggtaaatctaccaatcttgccaaggttgcatactggctgctacagcatgatatcagtgtcatgatggcagcttgtgatacatttaggtcaggtgctgttgagcagctccgaacgcatgcacgcagactccagatacctatatttgagaaaggttatgaaaaagatccagcaattgtagcaagagaagctattctggaggctagtcgtaataattcagatgttgttcttgttgatacagctggccggatgcaggacaatgaaccactgatgagagcactctccaagctcatcaatctcaacaacccagatttagttctttttgttggagaagcattggttggaaatgatgctgttgatcaactatcaaagtttaaccagaaactggcagacctatcaacagttcctaatgctaggttgatcgatggcatcctgcttaccaagtttgatacaatagatgataaggttggtgcggccctttccatggtttacatttctggagctcctgtaatgtttgttggctgtggtcagtcctatacagacctcaagaagctcaatgtcaagtccattgtgaaaactcttctgaagtgaattctgttccacatactctcacatgactgcctgtagcttctttgtgaacttaaatcccccatgacctcattgtctcgacttcagaagtgaatcagtttgctgttatttaaattcatggattgatttatcttttgttataatgtgttctctgtttgatttttgctcttgtcgattagatgtttgcaaaagccgaag

SEQ ID NO: 90 - DNA, 2037 bp, Elaeis guineensis
ggaattcgagatgttggagcagctgctgatcttcacgcggggcgggctgatcctgtggacgtatcgggagctcggcaacgcccttaagggctcccccgtcgacgctctcattcgctcctgcctcctcgaggagcgctccgccgagacctccttcagctacgacgcccctgtcggcggcgccgcctacaccctcaagtgggccttccacaacgaccttggcctcgttttcgtcgccgtctaccagcggatcctccacctcctctacgtcgacgacctactcgccgccgtccgccgcgagttctcgcagatatacgaccctaagcgcacggcatacgatgagttcgatgagatcttccggcagctccagaaggaggccgaggctcgcgccgaggagatgaggaagtcgaagcagtctaatagggcccttcccgtggctggaaagaagcaggggccaggccagagggctgggtctcagggaaacgggaagcagaaaggcgcgaaagtttgttctggtaaagatgatggtgatggtgagtcgggcgaagggcgtgggttatcaaaagggagctcgaacgggcaggagaatggaatcaaggagtcttctcgtgccccgagtgttgttgttaagggaaaagaggacggaacccccgaagtgggggctttcgatgtaaataagctacagaagttacgctccaaaggtggaaagaagtcggatgcaggtggtggtggtgggaaggcttcgaaggcagagctgaagaagatagtgaagaaaaatagggtttgggatgattcgccttccaagtcaaggctggattttacagatccaggagatgagaaaggggacaacatcgcagatgttgtgacagcagatcaaggagagagcatgatggacaaggaggaaattgtgagcagtgagagtgagagtgaggaagatgaggaactggagtgtgccaaatctggcaccaagaagaagggatggttctcatcaatgtttcagagcattgcaggtaatgctgttttggagaggtcggacttgacaccagcattgaaagctcttaaggataggttgatgactaaaaacgtggcagaggaaatagctgagaagctttgtgaatcagtagcagccagtcttgaagggaaaaaactgggatctttcacgagagtttcctctaccgtccagacagcaatggaggaggctcttcttcgcattttaactccaaaaagatccattgacattttgagagatgtacatgctgctaaagagcaagggaagccatatgttatagtttttgttggtgttaatggagttgggaaatctaccaatctcgccaaggttgcatactggctcctccagcataatatcagtgtcatgctggcagcatgtgacacatttaggtcaggtgccgttgagcagctccgtacgcatgcacgcagactccagatacctatatttgagaaaggttatgaaaaagatccagcgattgtagcaagagaagctattcaggaggcttctcgtaatagttcggatgttgttcttgttgatacagctggccggatgcaggacaatgaaccactgatgagggcactctccaagctcatcaatctcaacaacccagatttagttctttttgttggagaagcattggttggaaatgatgcagtcgatcaactatcaaagtttaatcagaaattagcagacctatcaacagttcctaatgctaggttgattgatggcatcctgcttaccaagttcgatacgatcgatgataaggttggtgcagctctttccatggtttacatttctggagctcctgtaatgtttgttggctgtggtcagtcctatacagacctcaagaagctcaacgtcaagtccattgtcaaaactcttctgaaatgaatgctgttccgcatactctccacatgactggctgttgcttctttgcaaacttaaatcccccatgacctcatcgtcttgactttggaagtggaatcaatctgctattgtttaaatccatatcatcaatttatcttttggta

SEQ ID NO: 91 - DNA, 2246 bp, Elaeis guineensis
gcagccccaaccctataaatatcccaacccaaagaaaacgcgttgaacccgtcgcctccccctttctccaccttcctctctctttctattttcttatcggttaattttttctaggttttcttctaggcggaactcaatcgagaatttttccagttcttggattttggatcctcgatctgatcgagtttggaggagagatgttggagcagctgctgatcttcacccggggagggctgatcctgtggacgtgcggcaacgccctcaagggctccccgatcgacgccctcatccgctcctgcctcctcgaggagcgctccgccgagacgttcttcagctacgacgcccccgctggcggcgccgcctacaccctcaagtgggccttccataacgaccttggtctcgtcttcgtcgccgtctaccagcgatttctccaccttctctacgttgacgatctcctcgccgccgtccgcagagagttctcgcagatttacgaccccaagcgcacggcgtacgatgaattcgatgagatcttccggcagctgcagaaggaggccgaggctcgcgccgaggagatgaggaagtcgaagcagtctaatcgggcccctctcgtggctggaaagaagcagggggcgggcgccggccagagggcgggatcgcagggaaacgcgaagcagaaaggtggtaaaggtagttctggtaaagatgatggtgatggtgagttgggcaaagggcgtgggttgtcgaatgggcgggagaatggaatcaaggagccttctcgtgccccgagtgttgttgttaagggaaaagaaaacggagcccccgtttcgggggccttcgatgtaaataagttacagaagctgcgcccaaaaggtgggaagaaaatagatactggtagtgggaaggcttccaaggtggagccaaagaagacagtaaaaaagaatagggtttgggatgattcaccttccgattcgaggctggatttcacggatccagcagatgagaaaggggatgaggtcgtagatgttggaaaggcagatcatggagagagcatgatggacaaggaggaaattgtgagcagcgagagtgagagcgaggaagatgaggaagtggagactaccaagcctggcaccaagaagaaagggtggttctcatcaatgtttcagagcattgcaggtaatgctgttttggagaaggcagatttgaaaccagcattgaaagctcttaaggataggttgatgactaaaaatgtggcagaggaaatagctgagaagctttgtgaatcagtagcagctagtcttgaagggaaaaagctgggatctttcacaagagtttcctcaactgtccagacagcaatggaggaggctcttcttcgtattttgactccgaaacgatccattgacattttgagagatgtacatgctgcaaaagagcaagggaaaccatatgttatcgtttttgttggtgtcaatggagttggtaaatctaccaatcttgccaaggttgcatactggctcctacagcatgatatcagtgtcatgatggcagcttgtgatacatttaggtcaggtgctgttgagcagctccgtacgcatgcacgcagactccagatacctatatttgagaaaggttatgaaaaagatccagcaattgtagctagagaagctattcaggaggctagtcataataattcagatgttgttcttgttgatacagctggccggatgcaggacaacgaaccgctgatgagagcactttccaagctcatcaatctcaacaacccagatttagttctttttgttggagaagcattggttggaaatgatgctgttgatcaactatcaaagtttaaccagaaactggcagacctatcaacagttcctaatgctaggttgatcgatggcatcctgcttaccaagtttgatacaatagatgataaggttggtgcggcgctttccatggtttacatttctggagctcctgtgatgtttgttggctgtggtcagtcctatacagacctcaagaagctcaatgtcaagtccattgtgaaaactcttctcaagtgaattctgttccacatgctttcatatgactgcctgttgcttctttgcgaacttaaatcccccatgacctcattgtcttgactttggaagtgaatcagtttgctgttgtttaaattcatggattgatttgtcctttgttataatgtgttctctgtttgatttgtgctctagttgattatatgtttg

SEQ ID NO: 92 - DNA, 2277 bp, Elaeis guineensis
gcggacggcgcaaccccacacacagctcccataaataccctctccagaaaaagggtgcgttgaactcgtccccctcccccttcctccaccctccttcctctctctctctttattttcattttatttttttcaaggtttcttcagaaagccggaaagtaagccaggaattcgagatgttggagcagctgctgatcttcacgcggggcgggctgatcctgtggacgtatcgggagctcggcaacgcccttaagggctcccccgtcgacgctctcattcgctcctgcctcctcgaggagcgctccgccgagacctccttcagctacgacgcccctgtcggcggcgccgcctacaccctcaagtgggccttccacaacgaccttggcctcgttttcgtcgccgtctaccagcggatcctccacctcctctacgtcgacgacctactcgccgccgtccgccgcgagttctcgcagatatacgaccctaagcgcacggcatacgatgagttcgatgagatcttccggcagctccagaaggaggccgaggctcgcgccgaggagatgaggaagtcgaagcagtctaatagggcccttcccgtggctggaaagaagcaggggccaggccagagggctgggtctcagggaaacgggaagcagaaaggcgcgaaagtttgttctggtaaagatgatggtgatggtgagtcgggcgaagggcgtgggttatcaaaagggagctcgaacgggcaggagaatggaatcaaggagtcttctcgtgccccgagtgttgttgttaagggaaaagaggacggaacccccgaagtgggggctttcgatgtaaataagctacagaagttacgctccaaaggtggaaagaagtcggatgcaggtggtggtggtgggaaggcttcgaaggcagagctgaagaagatagtgaagaaaaatagggtttgggatgattcgccttccaagtcaaggctggattttacagatccaggagatgagaaaggggacaacatcgcagatgttgtgacagcagatcaaggagagagcatgatggacaaggaggaaattgtgagcagtgagagtgagagtgaggaagatgaggaactggagtgtgccaaatctggcaccaagaagaagggatggttctcatcaatgtttcagagcattgcaggtaatgctgttttggagaggtcggacttgacaccagcattgaaagctcttaaggataggttgatgactaaaaacgtggcagaggaaatagctgagaagctttgtgaatcagtagcagccagtcttgaagggaaaaaactgggatctttcacgagagtttcctctaccgtccagacagcaatggaggaggctcttcttcgcattttaactccaaaaagatccattgacattttgagagatgtacatgctgctaaagagcaagggaagccatatgttatagtttttgttggtgttaatggagttgggaaatctaccaatctcgccaaggttgcatactggctcctccagcataatatcagtgtcatgctggcagcatgtgacacatttaggtcaggtgccgttgagcagctccgtacgcatgcacgcagactccagatacctatatttgagaaaggttatgaaaaagatccagcgattgtagcaagagaatctattcaggaggcttctcgtaatagttcggatgttgttcttgttgatacagctggccggatgcaggacaatgaaccactgatgagggcactctccaagctcatcaatctcaacaacccagatttagttctttttgttggagaagcattggttggaaatgatgcagtcgatcaactatcaaagtttaatcagaaattagcagacctatcaacagttcctaatgctaggttgattgatggcatcctgcttaccaagtttgatacgatcgatgataaggttggtgcagctctttccatggtctacatttctggagctcctgtaatgtttgttggctgtggtcagtcctatacagacctcaagaagctcaacgtcaagtccattgtcaaaactcttctgaaatgaatgctgttccgcatactctccacatgactggctgttgcttctttgcaaacttaaatcccccatgacctcatcgtcttgactttggaagtggaatcaatctgctattgtttaaatccatatcatcaatttatcttttggtatatgcgttctctgtttattttttgctctagtcaatcagaatgctgctgaaaccaaatgaatctgttgttgataattg

SEQ ID NO: 93 - DNA, 2261 bp, Elaeis guineensis
ctttctattttcttatcggttaattttttctaggttttcttctaggcggaactcaatcgaggtatcattcgtttctctcaatccctattctcaagaaatcagggtggttctaatccatctaatcccttcgatctccctttcttttcgtcgattcctattagaatttttccagttcttggattttggatcctcgatctgatcgagtttggaggagagatgttggagcagctgctgatcttcacccggggagggctgatcctgtggacgtgcggcaacgccctcaagggctccccgatcgacgccctcatccgctcctgcctcctcgaggagcgctccgccgagacgttcttcagctacgacgcccccgctggcggcgccgcctacaccctcaagtgggccttccataacgaccttggtctcgtcttcgtcgccatctaccagcgatttctccaccttctctacgttgacgatctcctcgccgccgtccgcagagagttctcgcagatttacgaccccaagcgcacggcgtacgatgaattcgatgagatcttccggcagctgcagaaggaggccgaggctcgcgccgaggagatgaggaagtcgaagcagtctaatcgggcccctctcgtggctggaaagaagcagggggcgggcgccggccagagggcgggatcgcagggaaacgcgaagcagaaaggtggtaaaggtagttctggtaaagatgatggtgatggtgagttgggcaaagggcgtgggttgtcgaatgggcgggagaatggaatcaaggagccttctcgtgccccgagtgttgttgttaagggaaagaaacggagcccccgtttcgggggccttcgatgtaaataagttacagaagctgcgcccaaaaggtgggaagaaaatagatactggtagtgggaaggcttccaaggcggagccaaagaagacagtaaaaaagaatagggtttgggatgattcaccttccgattcgaggctggatttcacggatccagcagatgagaaaggggatgaggtcgtagatgttggaaaggcagatcatggagagagcatgatggacaaggaggaaattgtgagcagcgagagtgagagcgaggaagatgaggaagtggagactaccaagcctggcaccaagaagaaagggtggttctcatcaatgtttcagagcattgcaggtaatgctgttttggagaaggcagatttgaaaccagcattgaaagctcttaaggataggttgatgactaaaaatgtggcagaggaaatagctgagaagctttgtgaatcagtagcagctagtcttgaagggaaaaagctgggatctttcacaagagtttcctcaactgtccagacagcaatggaggaggctcttcttcgtattttgactccgaaacgatccattgacattttgagagatgtacatgctgcaaaagagcaagggaaaccatatgttatcgtttttgttggtgtcaatggagttggtaaatctaccaatcttgccaaggttgcatactggctcctacagcatgatatcagtgtcatgatggcagcttgtgatacatttaggtcaggtgctgttgagcagctccgtacgcatgcacgcagactccagatacctatatttgagaaaggttatgaaaaagatccagcgattgtagcaagagaagctattcaggaggctagtcataataattcagatgttgttcttgttgatacagctggccggatgcaggacaacgaaccgctgatgagagcactttccaagctcatcaatctcaacaacccagatttagttctttttgttggagaagcattggttggaaatgatgctgttgatcaactatcaaagtttaaccagaaactggcagacctatcaacagttcctaatgctaggttgatcgatggcatcctgcttaccaagtttgatacaatagatgataaggttggtgcggcgctttccatggtttacatttctggagctcctgtgatgtttgttggctgtggtcagtcctatacagacctcaagaagctcaatgtcaagtccattgtgaaaactcttctgaagtgaattctgttccacatgctctcacatgactgcctattgcttctttgcgaacttaaatcccccatgacctcattgtcttgactttggaagtgaatcagtttgctgttgtttaaattcatggattgatttgtcctttgttataatgtgttctctgtttgatttgtgctctagttgattatatgtt

SEQ ID NO: 94 - DNA, 2094 bp, Phoenix dactylifera
cctccctctttgtccatctcctccctctttctattttcttctctctttatttttctaggttttcttctaggcgggactcaatctagttcttggatctgatcgagtttggagaagagatgttggagcagctgctgatcttcacccggggcgggctgatcctgtggacgtgcggcaacgccctcaagggttccccgatcgacaccctcatccgctcctgcctcctcgaggaacgctccgccgagacctccttcagctacgacgccccggccggcggtgccgcctacaccctcaagtgggccttccacaacgacctcgacctcgtcttcgtcgccgtctaccagcggattctccacctcctctacgtcgacgatctcctcgccgccgtccggagagagttctcgcagatttacgaccccaagcgcacggcgtacgatgaattcgatgagatcttccggcagctccagaaggaagccgaggctcgcgccgaggagatgaggaagtcgaagcagtctaatcgggcgtctctcgtggctgggaagaagcagggggcgggcgccggccagagggctggggggcagggaaatgcgaagcagaaaggtgggaaagctggttctggtaaagatgatgatgatgatggtgagtcgggcagagggcgtgggttatcgaacgggcgggagaatggaatcaaggagccttctcgtgcccggagtgttgttgttaaaggaaaagacaacggagcccccgaagtaggggctttcgatgtaaataaactacagaggctgcgcccaaaaggtgggaagaaaacagatactggtggctggagggcttccaaggcggagccaaaaaagatagtaaagaaaaatagggtttgggatgattcaccttccgattcgaggctggatttcacggatccagtggatgagaaaggggatgagatcgtagatgttgggaagacagatcatggagagagcatgatggacaaggaggaaattgtgagcagcgacagtgagagcgaggaagatgaggaagtggagagtgccaagcctggcaccgagaagaaagggtggttctcatcaatgtttcagagcattgcaggtaaagctgttttggagaaggcggatttgaaaccagcattgaaagctcttaaggataggttgatgactaaaaatgtggcagaggaaatagctgagaagctttgtgaatcagtagcagctagtcttgaagggaaaaagctgggatctttcacaagagtttcctcaaccgtccagacagcaatggaggaggctcttcttcgcattttgactccgaaacgttccattgacattttgagagatgtacatgctgccaaagagcaaggaaaaccatatgttattgtttttgttggtgtcaatggagttggtaaatctaccaatcttgccaaggttgcatactggctcgtacagcataatgtcagtgtcatgatggcagcttgtgatacatttaggtcaggtgctgttgagcagctccgtacgcatgcacgcagactccaggtacctatatttgagaaaggttatgaaagagatccagcgattgtagcaagagaagctattcaggaggccagtcgtaataattcagatgttgttcttgttgatacagctggccgcatgcaggacaatgaaccactgatgagagcactctccaagctcatcaatctcaacaacccagatttagttctttttgttggagaagcattggttggaaatgatgctgttgatcaactatcaaagtttaaccagaaattggcagacctatcaacagttcctaatgctaggttgatcgatggcatcctgcttaccaagtttgatacaatcgatgataaggttggtgcagccctttccatggtttacatttctggagctcctgtaatgtttgttggctgtggtcagtcctatacagacctcaagaagctcaatgtcaagtccattgtgaaaactcttctgaagtgaattctgttccacactctcacatgactgcctgttacttctttgcgaacttaaatcccccatgacctcatcgtcttgactttggaagtgaatcagtttactgttgtttaaa

SEQ ID NO: 95 - DNA, 2227 bp, Musa acuminata
ccggataccgcattcatccatttaagtaaaccgcccaccgcaaggaaacgttcaacgcgttttctctcctccgctccgttcatctcctggcacttctcttgaacccgtcttctccttttctcttcgttcatctcccctttctttttcctcatcctttgccagggtttagaattctaacatccgatctggttgcttggagtcgaagatgttggaccagctgctgatctttacgcggggtgggctgatcctgtgggagctcggcagctcgctcaagggatccccgatcgacgcgctcatccgctcctgcctcctcgaggagcgctccgcagacgcggccttccactacgacgctcccggcgccgccggcggagccgcctacaccctcaagtgggtcttcgacaacgacctcggcctcgtcttcgtcgccgtctaccagcgcatctttcatctcctctacgtagacgatctcctcgcggccgtccgccgcgagttctcccggatccacgaccccagtcgcacgtcgtacgatgatttcaacgagaccttccgccagctccagaaggaggccgaggcgcgggcggaggagatgcgcaagtccaagcaggctgcccgctcagatggcgattcaggaaagggccgttggttagcgaatgttggggcattcgatgtaaacaagttacagaagttgcggtccaaaggtgggaagaagacggacactggtggcgttgggagcaaggccaccaaggcggagccaaagaagaatgtgaagaagaacagggtttgggatgattcaccttctgagtcgagattggattttacgaatccagtggatgagagaggggaagagcctctggaggttgtggaggcagatcggggagagagcatgatggataaggaggaaattgtgagcagcgaaagtgagagtgaggaagatgaggaagtggagaatgaaaaaccttgcacgaagaagaaggggtggttctcgtctatgttccaaagtattgcaggtaatgctgtgttagagaagtctgacttgaaaccagccttgaaagctctcaaggataggttgatgactaaaaatgtggctgaggaaatagctgaaaagctttgtgaatcagtagcagctagtcttgaggggaaaaaactgggctcctttacgagagtttcttcaacagttcagacagccatggaagaggcacttcttcgtattttaacaccaaagagatccattgacattttgcgagatgtccatgtcgctaaggagcaaggaagaccttatgttgttgtttttgttggtgtcaatggagttggaaaatctaccaatcttgccaaggttgcatactggcttttgcaacatgaagttaatgtcatgctggcagcatgtgatacattcaggtctggtgctgttgaacagcttcggactcatgcacgcagactccagatacctatcttcgagaaaggctacgaaaaggatcccgcaattgtagcgaaagaagctatccaggaggctaaatccaataattcagatgttgtccttgtcgacacagctggccgtatgcaggataatgagccactgatgagagcactctccaagctcatcaacctcaacaacccagatctggtactttttgttggagaggctttggttggaaatgatgctgtggatcaattaaccaagttcaaccagaaattagcagacctgtccacgatttcgaatgccaggttgatcgatggcatcctgctcaccaagttcgacacgattgatgataaggttggagcagctctttccatggtctatgtttcaggagctccagtgatgtttgttggttgcggtcagtcctacaccgaccttaagaagctcaacgtgaagtccattgtcaaaactcttctgaagtgagcgtagtaccgctgtctgaacttttagtcccccatgacctcattctcttgacgtcttaagcaaatgaatcatactggctctgctgtagattctttcaagcgatgatgtctattctttaacaagaattgctttcttgttataattttagaaactcttaatcacattttgatagtagcattatctcgaataccagccccaatctgtatataccaatccgagaaaggattggtatcggactctacgattcggtcagtatttaattttaattttaatttttcagctgatacaggtttgattaactatcaaatgtattagtccgatgaagtattg

SEQ ID NO: 96 - DNA, 1884 bp, Ananas comosus
atgttggagcagcttctgatcttcacccgcggggggctgatcctgtggtcgtcgtgccgtgggctcggcaacgcgctcaagggctcgccgatcgacgccctgatccggtcgtgcctcctcgaggagcgctcggccgagacctccttcgcccacgacgcctacaccctcaagtgggccttccacaacgagctcggcctcgtcttcgtcgccgtctaccagcggattctccatctcctctacgtcgacgaccttctcgccgccgtgcgccgcgaatttgccgaaatctacgacccgaagcgcacctcctacgatgatttcgacgagaccttccgccagctccagaaggaggccgaggcccgcgccgaggagatgaagaagtccaagcaggccggccgcgccccggccgtgccgggcaagaagcagggtgccggcggtgctgcgcagcgcgacgctaagcagaaaggcagcggcgccggcggaggtggatccggaaaggacgatggggatggggatggggattcggggaagggacgctggttagccaacggtaatggaaacggccaggagaagggcgcgagggagcggtcgcacgctcctccgggctctgttgttgttaaaggtaaagagaatggcggcccccaagcgggggcttttgatgtaaataagttacagaagttgcgttcgaaaggtggcaagaagagtgacaacactaagccggcttcgaagggaggagagccgaagaagatcgtgaagaagaacagggtttgggatgattcgccttccgagtcgaggctggacttcactgatccggtagatgagagaggggaggggattgtggaggccgtggcggcggatcagggtgagagcatgatggataaggaggaagatttgagcagcgagagtgaggctgaagaagaagacgaggaagtggagggtgcaaaacctggcgcgaagaagaaagggtggtttacatccatgtttcagagcatcgctggtaatgctattattgagaagtcagatctacaaccagctctgaaagctctcaaggacagattgatgactaaaaatgtggcagaggagatagctgagaagctttgtgagtcagttgcagctagtcttgagggaaaaaagctgggatccttcaccagaatatcttcaactgttcagacggcaatggaagaggctcttcttcgcattcttactcctaaacgctccattgacattttgagggaggtgcatgctgctaaagagcatggaaaaccatatgttattgtgtttgttggtgtgaatggagttgggaaatctaccaatcttgcaaaggttgcatactggcttcttcaacacaatatcagtgtcatgctcgcagcatgcgataccttcaggtcaggtgctgttgaacaactgcgcacacatgcccgcaggcttcagattcctatatttgaaaaagggtatgaaaaagatcctgccgtagtagcaagggaagctattcaggaagcaagtcgcaataaatcagatgttgttcttgttgatacagctggacggatgcaggacaatgagccactgatgagagcactctccaagctcatcaatctcaacagcccagatttggttttgtttgttggagaagctctggttggaaatgatgctgttgatcaactttcaaagttcaaccagaaattagctgatctttcaacagttcctaacgcgagattgattgatggcatccttctcaccaaatttgacacaatcgatgacaaggtcggggctgctctttctatggtgtacatctctggagctcccgtgatgttcgttggttgtggccagtcttacactgatctcaagaagctgaatgttaagtctatcgtgaaaactctgttgaagtga

SEQ ID NO: 97 - DNA, 2399 bp, Ananas comosus
atcgaggaggagggatgttggagcagcttctgatcttcacccgcggggggctgatcctgtggtcgtcgtgccgtgggctcggcaacgcgctcaagggctcgccgatcgacgccctgatccggtcgtgcctcctcgaggagcgctcggccgagacctccttcgcccacgacgcctacaccctcaagtgggccttccacaacgagctcggcctcgtcttcgtcgccgtctaccagcggattctccatctcctctacgtcgacgaccttctcgccgccgtgcgccgcgaatttgccgaaatctacgacccgaagcgcacctcctacgatgatttcgacgagacgttccgccagctccagaaggaggccgaggcccgcgccgaggagatgaagaagtccaagcaggctggccgcgccccggccgtgccgggcaagaagcagggtgccggcggtgctgctcagcgcgacgctaagcagaaaggcagcggcgccggcggaggtggatccggaaaggacgatggggatggggatggggattcggggaagggacgctggttagccaacggtaatggaaacggccaggagaagggcgcgagggagcggtcgcacgctcctccgggctctgttgttgttaaaggtaaagagaatggcggcccccaagcgggggcttttgatgtaaataagttacagaagttgcgttcgaaaggtggcaagaagagtgacaacactaagccggcttcgaagggaggagagccgaagaagatcgtgaagaagaacagggtttgggatgattcgccttccgagtcgaggctggacttcactgatccggtagatgagagaggggaggtgattgtggaggccgtggcggcggatcagggtgagagcatgatggataaggaggaagatttgagcagcgagagtgaggctgaagaagatgacgaggaagtggagggtgccaaacctggcgcgaagaagaaagggtggtttacatccatgtttcagagcatcgctggtaatgctattattgagaagtcagatctacaaccagctctgaaagctctcaaggacagattgatgactaaaaatgtggcagaggagatagctgagaagctttgtgagtcagttgcagctagtcttgagggaaaaaagctgggatccttcaccagaatatcttcaactgttcagacggcaatggaagaggctcttcttcgtattcttactcctaaacgctccattgacattttgagggaggtgcatgctgctaaagagcatggaaaaccatatgttattgtgtttgttggtgtgaatggagttgggaaatctaccaatcttgcaaaggttgcatactggcttcttcaacacaatatcagtgtcatgctcgcagcatgcgataccttcaggtcaggtgctgttgaacaactgcgcacacatgcccgcaggcttcagattcctatatttgaaaaagggtatgaaaaagatcctgccgtagtagcaagggaagctattcaggaagcaagtcgcaataaatcagatgttgttcttgttgatacagctggacggatgcaggacaatgagccactgatgagagcactctccaagctcatcaatctcaacagcccagatttggttttgtttgttggagaagctctggttggaaatgatgctgttgatcaactttcaaagttcaaccagaaattagctgatctttcaacagttcctaacgcgagattgattgatggcatccttctcaccaaatttgacacaatcgatgacaaggtcggggctgctctttctatggtgtacatctctggagctcccgtgatgttcgttggttgtggccagtcttacactgatctcaagaagctgaatgttaagtctatcgtgaaaactctgttgaagtgaatgtgatatttcgctctgtctcgcctgcatggcttctattttcgtgttatctttgaatcccctatgacctcatcatcttggcactggaagtggatcatttcatggctacagtttttcatattaatgtagttgtttgttttatgcgacgtagtgtaacagtaaccaagttaatgctgtaagcaggtaactgtgttcatcgtttggatggtgcctttttggtgtttgatttctgcccccggcccctctttttgtatccgtcattgattgtattaactgatatcggtaacacgccgatataacatatgaactgaaaaacatgcaataaatagttgagaggtgtcccgcattagcttaactaaggcaattcatgtgcttcctcatctcaattgcatctgaatttggatattcattaggcttgttgaccgttggattatcattttaagtttgttgaacccaaagaatgaatcgcgtatttggatgtttccttttatatactcaata

SEQ ID NO: 98 - DNA, 2111 bp, Amorphophallus konjac
agggttctctggagagatgttggagcagctgctgatctttacccggggcggactgatcctgtggacctgcaaggagctcggaaacgccctcaaggggtccccgatcgacaccctgattcggtcctgcctcctcgaggagagatccgccgatgcgtcctacaactacgacgcccccaccgccggcgccgcctacaccctcaagtggaccttccacaacgagcttggccttgtcttcgtcgccgtctaccagcggatcctccacctgctctacgtggacgacctcctcgccgcggtgaagcgcgaattcgctgaaatctatgatccccggcgcgtggcttatgatgactttgatgagatttttcgtcagctccagagggaggcggaggcgagggccgaggagatgaggaagttgaagcaggccatgtcgagggcaccggtcagtggtggggtgaagaagcaagggcagatcaatgggcacaaggctggatcgcagggcaatgggaagcagaagagtagtgatggctctgggaaggatgattccgatggtgattcccgtaaagccgatggtgtggcgaatggtaatcaccatgggcgccagaaccagtccaagggatctcgtcgtgcggctggtgttgtgaaaactgaggagaaaagctccgatggggcttttgatgtaaataagctacagaagatgcgttctaaaggggccaagaaaactaacacagttgttgtagggaagggtacaaacgtggaaccaaagaagataacaaagaagaaccgggtttgggacgattcaccttctgagtcaaggctggattttacagatccagtagatgagagaggggaagggaacacagaaattgttgcggcagatcagggtgaaagcatgatggacaaggaggaagatgtgagcagtgatagtgatagcgaggttgatgaggctcctgagagtacaaagacaaactccaagaagggctggtttacatctgtttttcagagcatttctggaaatgccgttttggaaaagtctgatttgcagccagccttgaaagctctaaaggataggctaatgaccaaaaatgtggctgaagaaatagctgaaaaactttgtgaatcagtagcagctagtcttgaagggaaaaagctaggatcatttacaagaatttcttctactgttcaggcggcaatggaggaagctcttctccgtattttgactccaaaacgatctattgacatcttgagggatgtgcatgctgccaaggagcaaagcaaaccctatgtcattgttttcatcggtgtcaatggtgttgggaaatccaccaatcttgctaaggttgcatactggcttttgcagcataagctgaatgttatgatggctgcttgtgacacttttcggtctggtgctgtagagcaactgcgtacacatgctcgtagactccagatacctatatttgaaaagggatatgagaaagatcctgcaatagtcgcaaaggaggcaattcaggaggctagtcgtaacaagtcagatgttgttctagttgatactgctgggcgaatgcaggataatgaaccattgatgagggcactttccaagctcatcaacctcaacaagccagatctagtactgtttgtgggagaggcgctggttggaaatgatgctgtggaccaactgactaaatttaaccagaaactggcagacctctctatgacccctaatgcgaggctgattgacgggatcctgctcactaaatttgacaccatcgacgacaaggtgggagcggcactgtccatggtctacatttccggggcgccggtgatgttcgttggctgtggacaatcctacaccgacctgaagaagctcaatgttaagtcaattgttaagaccctcctgaagtaaggggggtgccgccgtgtagtggctttagtagtttgatgtggggtgtgtgtctgtgctgtgtgccgtccaaaaaagtgctgccgctggtttctgtgaaccttattcccctatgacctcattagtcctgtcttttgaccgttctggtgaatcaaatacattgtggctttcgtacattgtggtaccatccaatgtgctatggagccggggattcttg

SEQ ID NO: 99 - DNA, 2328 bp, Phoenix dactylifera
cctccctctttgtccatctcctccctctttctattttcttctctctttatttttctaggttttcttctaggcgggactcaatctagttcttggatctgatcgagtttggagaagagatgttggagcagctgctgatcttcacccggggcgggctgatcctgtggacgtgcggcaacgccctcaagggttccccgatcgacaccctcatccgctcctgcctcctcgaggaacgctccgccgagacctccttcagctacgacgccccggccggcggtgccgcctacaccctcaagtgggccttccacaacgacctcgacctcgtcttcgtcgccgtctaccagcggattctccacctcctctacgtcgacgatctcctcgccgccgtccggagagagttctcgcagatttacgaccccaagcgcacggcgtacgatgaattcgatgagatcttccggcagctccagaaggaagccgaggctcgcgccgaggagatgaggaagtcgaagcagtctaatcgggcgtctctcgtggctgggaagaagcagggggcgggcgccggccagagggctggggggcagggaaatgcgaagcagaaaggtgggaaagctggttctggtaaagatgatgatgatgatggtgagtcgggcagagggcgtgggttatcgaacgggcgggagaatggaatcaaggagccttctcgtgcccggagtgttgttgttaaaggaaaagacaacggagcccccgaagtaggggctttcgatgtaaataaactacagaggctgcgcccaaaaggtgggaagaaaacagatactggtggctggagggcttccaaggcggagccaaaaaagatagtaaagaaaaatagggtttgggatgattcaccttccgattcgaggctggatttcacggatccagtggatgagaaaggggatgagatcgtagatgttgggaagacagatcatggagagagcatgatggacaaggaggaaattgtgagcagcgacagtgagagcgaggaagatgaggaagtggagagtgccaagcctggcaccgagaagaaagggtggttctcatcaatgtttcagagcattgcaggtaaagctgttttggagaaggcggatttgaaaccagcattgaaagctcttaaggataggttgatgactaaaaatgtggcagaggaaatagctgagaagctttgtgaatcagtagcagctagtcttgaagggaaaaagctgggatctttcacaagagtttcctcaaccgtccagacagcaatggaggaggctcttcttcgcattttgactccgaaacgttccattgacattttgagagatgtacatgctgccaaagagcaaggaaaaccatatgttattgtttttgttggtgtcaatggagttggtaaatctaccaatcttgccaaggttgcatactggctcgtacagcataatgtcagtgtcatgatggcagcttgtgatacatttaggtcaggtgctgttgagcagctccgtacgcatgcacgcagactccaggtacctatatttgagaaaggttatgaaagagatccagcgattgtagcaagagaagctattcaggaggccagtcgtaataattcagatgttgttcttgttgatacagctggccgcatgcaggacaatgaaccactgatgagagcactctccaagctcatcaatctcaacaacccagatttagttctttttgttggagaagcattggttggaaatgatgctgttgatcaactatcaaagtttaaccagaaattggcagacctatcaacagttcctaatgctaggttgatcgatggcatcctgcttaccaagtttgatacaatcgatgataaggttggtgcagccctttccatggtttacatttctggagctcctgtaatgtttgttggctgtggtgcttcatacagtacgtgagtgaatatacccaataagatcaaaatacagtaactcacggagtgccaatggcaactccccctcctccgaccaaagggcataccccgagtggtgggccacttaggcagctacccaatcggctgccccgttggcctccctgagaatcctgatgttcttcagcatcacgtgttggagcccatgttgaggacctcttgatgtcctcactgggggtgcaaactaacaaactaatccatgaattggctttggttaactagctccatcagtctagaaacacacatgctcttaaagattcaccaccaaaaaaaaaaaaagcttatttaacattttcagggaggatgcattgatgttggtgatgcgctgggtaaatgacagcttttcaggatattaa

SEQ ID NO: 100 - DNA, 1843 bp, Musa acuminata
ctctctctctctctctctctctctctctctctttctgttttgagtctgtggaaggagtaggtgctttggcaacttcatgactgaacattctaacaacagcttaattttttttgtttctgtaccataccatcctgattagttcctgtacatgcaaattatttgggcaggagaataggtttcttcttctctctcaagctagccactgtggtcttttgcagcatggacaactataaatggagagcagcagcatatgaggtgggagaaccttcttcttcttacaccatatcatatcatgaagccttattctccagagcttcagaatgggagcagcagaacaagcctgcagaacacccccaggatagtcctcctcctcactgccaccttgttcctcctcaccatcattcctctctatctcttccctttgctagccacatcgttcgcatggagaaacttatcctctccaccttcctccccttctccttctctttcttcttcctcttcctctccatcttcttcttctcgtgacatgagccgtgacgccatggctggtgtgacgatggccaagagctcgtgtgatatctttaggggggagtgggtgcccaaccctaacgcgccttactacaccaacgagacgtgctgggccatccatgagcaccagaactgcatgaagtttgggaggccggacacggagttcctgaagtggaggtggaagccgaacgactgcgatctgcccatctttaacccggcgcagttcttggagctcgtcagagggaagtcactggccttcgttggagactcggtggggaggaaccaaatgcaatccctcatctgcctcctgctcagagtcacatatgcggtggatgcgtcggtcactgaagatgagaagttccggcggtatcacttcccgacccacaacttcacggtggccagcttctggtctccgttcctggtgagggcacacgaagccgaccccaatggcccaaccctcaccggcctcttcaacctccacctggaccaagtggacaccaactggaccacccagatgacgccgttcgactacgtcatcgtctccgccggccactggttcttccgccccaccatgttcttcgaggccgaccagctcgtcggctgccactactgcctccaccccaacgtcaccgacctgaccatgtactacagctaccggagggccttcagggccgcgctccgggccttcaacgacctcccgggcttcaggggcacggtgttcctccggaccttcgcgccgtcgcacttcgagaacggcgagtggaacaaggggggcaactgcgtgcggcagcggccgttccggagcaacgagacaaggatggacggctacaacctggagatgtacatggcgcagctggaggagtaccgggcggcggagggcgaggggaaggagaagggcgtcaggtttcggttgctggataccacggaggcgatgctactaaggccggacggtcacccgggccggttcggccaccgccccgacgagaacgtgactctctacaatgactgcgtccactggtgcttgccggggccgatcgacaactggaacgatttcctgctccatatgctgaagaacgagggtggcagatcagccgccggccgacgatccaggaacgacaggaagtccacgatcaaataggtgatcaacattgcttctctttttgttcttagagcacgtaatttgtattttaattagtataccatactgtggtctacatgaattttggtttgttctttctccatgcatcaaaaggttgtagaaagctgtgtgataagccattaccgtgagaccaatgtcaataattgttgtgctgaa

SEQ ID NO: 101 - DNA, 1832 bp, Musa acuminata
tgaggcagtaattgacatagttaatctctcttctatcttcaccatgtctctctcttccactcccttcatagtttgcggaagaaggtagtttggcaacttcatgactgaccctttcaacaatagcttatagttttttctctctgcactatctcccaccttacttccggtacatgcaaataataggatatgtgtatatatatacacacacacacagtttgtgttctatatataaacagcaagcaagcagcagctagtatcagacagaggaagaagctacctgcaccaaagttttgtcccctgcttctatctgcccccatgaaggctaactcatgcccggagcttcagaatgggagcagaacgagccttcagaacacctccaggatcgttcttcttctgactgcaaccctcctcctcctcaccatcattcctctatatctcttccctttgttagccacatcacttgcatggagaagcctgtccgattcatcatcatcatcatcatcttcttcttcttcgggtgacatggcccgtgattccattgccggtctgggagtggcacagcattcatgtgacatcttccgaggggagtgggttccgaaccctaacgcgccgtactacaccaacgagagctgctgggccatccatgaccaccagaattgcatgatgtttgggaggcccgacacgggcttcatgaagtggaggtggaaaccgacccactgcgagctgccggtcttcaacccggcgcagttcctggagctcgtcaggggaaagtccctggcgttcgtcggcgactccgtcgggaggaaccaaatgcagtccctcatctgtctcctccacagagtgacgtacgtggtggatgcctccctcactcaagacgagaagttccgacgctatcacttccccacccacaacttcaccgtcgccagcttctggtctccgttcctggtaagggcccacgaagccgaccccaatggtcccacgcacactggcctgttcaacctgtacctggacgagcccgacaccaactggaccaccaagatgacggagttcgactacgtgatcgtgtcggccgggcactggtttttccggccggcaatgttcttcgagggcggccagctcgtcggttgccactactgcctggacccgaacgtcaccgacctgaccatgtactacagctaccggcgggcgttccgggcggcgttcggggtcttcaacagcctcgaaggattcagggggacggtgttcctgcggacgttcgcgccgtcgcacttcgagaacggcgagtgggacaagggggggaactgcgtgcggcagcagccgttccgcagcgacgagacgagactggacggcatcaacctcgagatgtacatgacgcaggtggaggagttccgggaggcagagatggaggggcgggagaagggcgtcaggttccggctgctggacaccacggatgcgatgctgctgaggccggacgggcaccccagccggtacggccaccggccgcacgagaacgtgacgatgtacaacgactgcgtgcactggtgcctgccggggcccatcgacacgtggaacgacttcttgctccacatgctgaagaacgagggtgggagagcgcgttctcggaacgcccggaagtccaccatcaagtagatgggtcgatgccttcctttctttggaaagtagatccactctgttctacatgaagaaagctgcattatacgtcagcgaaggtgctttgattgtttgaagacgaagctacaagctgtaagaaactatgaacgatgttctacattgatagctcaacaaatttatggaatatatatggaggagag

SEQ ID NO: 102 - DNA, 8804 bp, Musa acuminata
agacagaggaagaagctacctgcaccaaagttttgtcccctgcttctatctgcccccatgaaggctaactcatgccccgagcttcagaatgggagcagaacgagccttcagaacacctccaggatcgttcttcttctgactgcaaccctcctcctcctcaccatcattcctctatatctcttccctttgttagccacatcacttgcatggagaagcctgtccgattcatcatcatcatcatcatcttcttcttcttcgggtgacatggctcgtgattccattgccggtctgggagtggcacagcattcgtgtgacatcttccgaggggagtgggttccgaaccctaacgcgccgtactacaccaacgagagctgctgggccatccatgaccaccagaattgcatgatgtttgggaggcccgacacgggcttcatgaagtggaggtggaaaccgacccactgcgagctgccggtcttcaacccggcgcagttcctggagctcgtcaggggaaagtccctggcgttcgtcggcgactccgtggggaggaaccaaatgcagtccctcatctgtctcctccacagagtgacgtacgtggtggatgcctccctcactcaagacgagaagttccgacgctatcacttccccacccacaacttcaccgtcgccagcttctggtctccgttcctggtaagggcccacgaagccgaccccaatggtcccacgcacactggcctgttcaacctgtacctggacgagcccgacaccaactggaccaccaagatgacggagttcgactacgtgatcgtgtcggccgggcactggtttttccggccggcaatgttctacgagggcggccagctcgtcggttgccactactgcctggccccgaacgtcaccgacctgaccatgtactacagctaccggcgggcgttccgggcggcgttcggggtcttcaacagcctcgaaggattcagggggacggtgttcctgcggacgttcgcgccgtcgcacttcgagaacggcgagtgggacaagggggggaactgcgtgcggcagcagccgttccgcagcgacgagacgagactggacggcatcaacctcgagatgtacatgacgcaggtggaggagttccgggaggcagagagggaggggcgggagaagggcgtcaggttccggctgctggacaccacggatgcgatgctgctgaggccggacgggcaccccagccggtacggccacctgccgcacgagaacgtgacgatgtacaacgactgcgtgcactggtgcctgccggggcccatcgacacgtggaacgacttcttgctccacatgctgaagaacgagggtgggagagcgcgttctcggaacgcccggaagtccaccatcaagtagatgggtcgatgccttcctttctttggaaagtagatccactctgttctacatgaagaaagctgcattatacgtcagcgaaggtgctttgattgtttgaagacgaagctacaagctgtaagaaactatgaacgatgttctacattgatagctcaacaaatttatggaatatatatggaggagagacgttcataacatcaaatttggtgcatataaactattgcagcatacaccaattcgggcgaacaatgaagaaaatatgatgcaggtggtgcatatgcagtgaaaggagacactgtataaagttctgcaacattaaccataacttggcttcattgagcccttgaactcaagatgaaaggtgtaatactttactgacagtaaataggctaaatgagaacaagatcctccgataaccagagtttgaacttgaaagagcatcagattgcactcacagtgtgttctttgctgataaaacagtaatttcatcatggcctagaattgaagtggttcagcaaaaaaggtccctaaatactactagcctctgagcatggggtagaacactgtgtgtctactcttcaaatcattttgaaggaagttgagtgaaatcaagcgctgaatgagcataactgaaacttataatggttgcaaagataaattttggccaagaaaatggggtttgtatagtcaagttaattggttcatcatttttttcatatgttttcatacattggaaaaagatcttcttacagcctttaacaccttaaggttgcaagatcatgcagaccctttatttactaaccaactaaaacatgcagaatgttgatattaaggttgcaagaaggcagcacaaaaaaagaaaaaaaaaaccacacatctcaaggactaagtggaacaaattcagtaaaactaatgaagtaacttttgtgttctccgatatgagcaacttcaataatatatttcacatacatatccaacactagctaaattgatcgaggtctcatccactaggcgacccattctttacatgaaactatatgacattaacaatagagtctgacctaatagaggaagcaaactattttatcatagttactaagacaaacaagaaaataacataaatcaggcacttgagaatgacataataaaagtcctcaattaggaagtactcaagatttaacaaaataaagcatgaataataatctgaaagaaccggacgatctgtttaattggtcacactctcacttcttttgaaatgttacaaaagataacatggcatgaaggcctcaaaaagattgtgctccataggacagttaccaaaattcacacaagtatacaggaggagaaaagaaaagcaagaagatattcttgcatttaattgatgacacacagcaatagcaacaacattttaccttaaaaagagaaaataaactgctatcataatttcaatcaactagacaagtctattatcctgccaattgatttgaatacaaatacaaaggtatgttggtttttatgcatggtcagctatgccctgggaagctactatgtcttattaattatccaacaagtagagaaggtagtaaggtcattaggaaagaaaacaagaaagatgataattaaatatcatcatttttacacaaggtatccacgatatcagggctatttatacatcaaggaaaatgaggttggaaatacataaatgtagttatatctctcaaaatggttcctggcaagtttctcttctctcactcgccttgtctatcgtaatgcattaagaatttagacccttctacccaaaaaacagagtcaggcacacattcagcatgcagattacttgactgctttgttttccatatgcattgtattctaattcacaaagtatgcaatttatgtttttgcagataagaatgaaatataaaaccttgtcaatcatttgaaacacatccaacagaacacatgttataaacaggtagctatgtcatgcacgcaattaaataatccaaagatcagtattcatgaccaccaccatatttcagcaagtataattcacacaacaaaatacaccacatgctctcacagtaaaaaaaaaaacacatgtaccatatagctcttttctagaaaaatattgatgtttaaattctttatacagattcaccttcacgcattacaaacataacaaatatagatggtttcacatccgtgtagaacaaggaatcttggtaaaaggaataaattaaatgaaaaatattcctgtggctaaatgtcagaagaatatttatgtttaaattctttatacagattcaccttcaagcattgcaaacataacaaatatagagatgttcacatgcatgtagaacaaggaatctgggtaaaaggaattaattaaatgaaaaatattcgtgtggctaaatgttagaaaaatatttatgtttaaattctttatacagattcaccttcaagcattgcaaacataacaaatatagggaggttcacatccatggagaacaacaaatcttggtagaaggaataaattaaatgaaaaatatttctgaggctaactgtttaaacatcaaaatatggaatatatctcaatcatcttcataaaaactgtgccatcctgtcacattaatttgaccagttgagcttattttccccatttagtcctcccaaagccaagtttaagccatctcagagtatattccgacctctcattctcgacgaattaaccaataatggtagtttctgtaaataaagatttctagtagtcctctgctgtctgtttaatacaaaacatttacgtcctattcagtgaataatccaaaatatggatagatcaaatggtgaagataatgaaatgataaacgaatccaaaagaacaatgaaaaattgaaggcataagaaagaactgagagacattaaatcaaacatatttactgttttctctgtccatcatcacaactcaagacgtcacccattttgaatcgatctaaatgctgatggcaccattattcgttgattgaaattctgcagaatgccgacaataatctgagtaaaaaaaagggatcgaaatcggcatcgaatcggccgtatcaattagccctaacagctaccacctcttcattgcccaatcattatataagatgacgaaaacaagtggaggaagaaggtggggttggggggggagtgttttgggttggggggaggacggaggaatggttgtcggcggaagtccggatgcagaggtttatcgaccgattccggctttgtaacctcagcaagaaaagaaaccatcgaatccaccccgaaaagagaccgacaaggccaggaagagatcgataaaccgctgcgtccagagatcactcgattgctgcgaggaggacgaaaagggagaggagatatgagattcgagatggggatcacttactgtggcaatcatgttgtccgctttggatccgaaatggagaccggattggaattagagacgaggaagaggaagaggaggatcacaagagccgggcgacatgtgcttccatgaagaggggacgatggatgagctcatcatgagcaagaagagctactacgtactacccactcttttaccggtgtgttatttggagaaacgaaactagttcctgcgggacccactgcgggacccatccttcctatcagtagaaacaaagatggtgggttcgcatgaaattttgggtttgagtaaatcccgacacgattcttctgacgtactcatatcagctgtcttatccacggcacagaacattcgacttgaccgatcatcctgagacacagtgtgccatacgacacctgtgtgaaggcttcccgtgtttcgcgacgtggatgagacaggaaaagccgtgaggcaaattggtggcactccatcgctgttgacgttgatgcggtcaaggctgagccgtccgattcatgatccggccaggatgaccacatcgtcgcccacccgtaagtcgcatcaagattcgggacggctagatcaacggtgtcagatcagcttcagtgatatatataattaatcatgaccaggagtgattagcttgagttttctaaagggacacattaatatttgtaagaatcaataaagtatttttaaaattttttaagcattattatggaaagacacctattcaactatttatttctctatggctaaaaaatatacattgacacgtattgttttattataataagttgatttctaaagtatttaatgcattggattaaaatcacataaaaaggtatatttagtggcattcagacttgagctctaagtcttttataaaaaggaagtcactttacacctatacaaacataaatatacaaaggtctatttgtatcaataatatatatatatatatatatatatatatatatatatatatatatatatatatatatacccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccccctttattattcatgataagttaatttacaatactagtatcgaagtgtggaacatattaaaattgaaccaagcatctttatatgcacgatgtattcacttttgataaatgtatatgattgattttcaaatactttgaattcaaacattcaaatttattgtaaaatccttttggtgatacagataccaatgcatatgtctagtaatcattctgatgacatgagacaaagcaacctgcaccaaactttgctgcttctatctccccccatgaagggtaactcaggtcgggagcttcagaatggaagcaaaacgagccttcggaaaacctctaggatcgttcttcttctgactgcaaccctcctcctcaccatcattcctctatatctcttccctttgttagccacatcacttgcatggagaagccagtcctcttcttcatcatcatcttcttcttcttcgtcttcttcgagtgatatggctcgtgattccattgccggtctgggagtggcacagcattcgtgtgacatcttccgaggggagtgggttccgaaccctaacgcgccgtactacaccaacgagagctgcagggccatccaagagcaccagaattgcatgaagtttgggaggcccgacacgggcttcatgaagtggaggtggaaaccgacccactgcgagctgccggtcttcaacccggcgcagttcctggagctcgttagggggaagtccctggcgttcgtcagcgactccttggggaggaaccaaatgcagtccctcatctgtctcctcctcagagtgacgtacgtggtggatgcctccgtcacccaagacgacaatttccgacggtattacttccccacccacaacttcaccgtcgccagcttctggtcaccgttcctggtaagggcccacaaagtcgaccccaatgcctccacgtacagtggcatgttcaacctgtacctggacgagcccgacaccaactggaccaccaagatgacggagttcgactacgtgatcatgtcggccgggcactggcttttacggccgaccatgttctacgagggcggccagctcgtcggttgccacaactgcctggccccgaacgtcaccgacctgaccatgcactacagctaccggcgggtgttccgggcggcgttccgggtcttcaacagcctcgaaggattcagggggacggtgttcctgcggacgttctcgccgtggcacttcgagaacggcacgtgggacaacgggggggactgcgttcggcggcagccgttccgccgcgacgagacgagactggacggcatcaacctcgagatgtacatgacgcaggtggaggagttccgggaggcacagagggaaggacgggagaagggcgtcaggttccggctgctggacaccacggatgcgatgctgctgaggccggacgggcaccccagccggtacggccacctgccgcacgagaacgtgccgatgtacaacgactgcgtgcactggtgcctgccggggcccatcgacacgtggaacgacttcttgctccacatggtgaagaacgagggtgggtgagcgcgctcttggaacccccggaagtccaccatcaagtagatgggtcgatgccttcttttctttcgtaagtagatccaccctgttctacatgaagaaagccacattatgcgtcactgtgggtgctttgattgtttgaagacgaagctacaagctgtaataaactatgaatgatgttctatattgatagctgaacaaatttatggtatgacaccaataacatcaaatttggtgcatataaactattgcagcatacaccaattcggacgaacaatgaagaaaatatgatgcaggtggtgtatatgccgttaaaggagacactgtataaagttctgcaacattaactataacttggcttcattgagccctaaaactcaaaactgaaaggtgtaatactttaccgacagtaaataggctagatgagaacaagatcctccgataaccagagtttgaacttgcaagagcatcagattgcactcacagtgtgttctttgctgataaaacagtaatttcatcatggactagaattgaagtggttcagaaaaattggtccctaaatactactagccgattagcatgacgtagaacacagtgtgcgtctacccttcaaatcattttgaaggaagctgagtgaaatcaagggctgaatgagtataactgaaccttataatggttgcaaagataaattttggccgagaaaatggggtttgtgtagtcaagctaatcggttcttcatttttttcatatgtttttgtaccttggaaaaagatcttcttacagcctttaacaacttaaggttgcaagatcatgcagaccttttatttactaaccaattaaaacatgcagaatctagatattaaggtttgcaagaaggcagtgcaaaaatgaaaagccacacatctcaaggactaagtagaacaaattcagtaaaactaatgaagtaacttttgtgttctaagctatgagcaactttgataatatatttcacatgcatatctaacactagcaaaattgatcgagatctcatccactaggctacccattctttacatgaaactatatgacactaacaatagagtctgacctaatagaggaagcaaactattttatcatagttactaagacaaacaagaaaataacataaatcaggaacttgagaatgacatagtaaaagtcctcaattaggaagtgc

SEQ ID NO: 103 - DNA, 1804 bp, Musa acuminata
gtctctctcttccactcccttcatagtttgcggaagaaggtagtttggcaacttcatgactgaccctttcaacaatagcttatagttttttctctctgcactatctcccaccttacttccggtacatgcaaataataggatatgtgtatatatatacacacacacacagtttgtgttctatatataaacagcaagcaagcagcagctagtatcagacagaggaagaagctacctgaaccaaagttttgtcccctgcttctatctgcccccatgaaggctaactcatgcccggagcttcagaatgggagcagaacgagccttcagaacacctccaggatcgttcttcttctgactgcaactctcctcctcctcaccatcattcctctatatctcttccctttgttagccacatcacttgcatggagaagcctgtccgattcatcatcatcatcatcatcttcttcttcttcgggtgacatggcccgtgattccattgccggtctgggagtggcacagcattcatgtgacatcttccgaggggagtgggttccgaaccctaacgcgccgtactacaccaacgagagctgctgggccatccatgaccaccagaattgcatgatgtttggaaggcccgacacgggcttcatgaagtggaggtggaaaccgacccactgcgagctgccggtcttcaacccggcgcagttcctggagctcgtcaggggaaagtccctggcgttcgtcggcgactccgtcgggaggaaccaaatgcagtccctcatctgtctcctccacagagtgacgtacgtggtggatgcctccctcactcaagacgagaagttccgacgctatcacttccccacccacaacttcaccgtcgccagcttctggtctccgttcctggtaagggcccacgaagccgaccccaatggtcccacgcacactggcctgttcaacctgtacctggacgagcccgacaccaactggaccaccaagatgacggagttcgactacgtgatcgtgtcggccgggcattggtttttccggccggcaatgttcttcgagggcggccagctcgtcggttgccactactgcctggacccgaacgtcaccgacctgaccatgtactacagctaccggcgggcgttccgggcggcgttccgggtcttcaacagcctcgaaggattcagggggacggtgttcctgcggacgtacgcgccgtcgcacttcgagaacggcgagtgggacaagggggggaactgcgtgcggcagcagccgttccgcagcgacgagacgagattggacggcatcaacctcgagatgtacatgacgcaggtggaggagttccgggaggcagagatggaggggcgggagaagggcgtcaggttccggctgctggacaccacggatgcgatgctgctgaggccggacgggcaccccagccggtacggccaccggccgcacgagaacgtgacgatgtacaacgactgcgtgcactggtgcctgccggggcccatcgacacgtggaacgacttcttgctccacatgctgaagaacgacggtgggagagcgcgttctcggaacgcccggaagtccaccatcaagtagatgggtcgatgccttcctttctttggaaagtagatccactctgttctacatgaagaaagctgcatcatacgtcagcgaaggtgctttgattgtttgaagacgaagctacaagctgtaagaaactatgaacgatgttctacattggtagctcaacaaatttatggaatatatatggaggagagacgttcataacatcaaa

SEQ ID NO: 104 - DNA, 1545 bp, Musa acuminata
ctcccccctcctctgacactgcagtcctcaatttctctgtttccatctatgtggtaagcttgatacctgatagtgcaaacaaagcaaacaccccacaccttattattgtttggtcaccaccccctaaaactttctcagttttccagtgtcctgaaaatttctgcttctctttctatattgttccaagctttgtgatccctcaatacttttgctagtcccttatttagcttctcacaaccacaacccttcagccaaatcacatcaattcctttctctctcacttcttttcctttgctctcctatttgctttatttctcttcttcttcttcttccacctaagctcctcctaatgccctcttcttgccatggaaaccacaatggaggatatgctgaatcttcttatggagtaaaccaacaagagttttctggaataaactccatgcctactcccttccttacttccaagccttgaaaagaaaggatcacttctgctttacccctgcagcctagagagaggaaggtcaaaaaaaggacctcaaaaatagagagcacaaagtttaagagaatggatctttctggtcaagaaggagagatcccaatcccaataaccagtgtatatgttggtggtcatggccatggcagcatccatgacagccctcccatccaccacccctccaatggccctcctcctcctcccctatccactgccaccacagaggaccaccaccacaacaccaccaactcctacagcaccaagaaaggggtggtagtaaggtacagggagtgcctcaagaaccatgcagcttccatcggtgggaatgccactgatgggtgcggtgaattcatgcccagtggcgaggagggaactctggaggccttgaagtgctctgcctgcagctgccacaggaacttccacaggaaagagacagaaggagagccctgctgcgactggttctaccccctcagggggaggaaggtgatgggccacaagggcctcctcatctcaggatcagatgcatttggttacagccctgcatgcaatagcctcattccaagggccacacctcacaacatgatcatgcctctgggtgtcatgcagacctctgagtctgatgagatggaaggggtgggtgcgatgatggcaaggcctgtcgtggtgaagaagaggttcaggaccaagttcaccccagagcagaaggagaagatgctgagctttgctgagaaggtggggtggaggctgcagaagcaggaggagagtgtggtccagcagttctgccaggagattggggtgaagaggagggtcctcaaggtgtggatgcacaacaacaagcatcacttggcaaagaagaactctctccagcttgaatgaccactgaaatcctcttgcatcatcatgccaaatgctcatcttacaagttgagttttggtggtagcatgtcataactattttcttgtatcactttctgagattttctcttcattttccacactgtcataatcatgagtttaccaagctttagtgttaattatattaatgtttaggca

SEQ ID NO: 105 - DNA, 1463 bp, Musa acuminata
gtagtttcaagtgagtgggtggcttcgggtgggagaggatggctagacttggaggtgaggcaacgttgacatcccgcctactcttcttcttcttggtatcgacggcggtgatgggtggcagcgcgacggtggagacaaggagaagtgtgctggggaatggcctcggcagaactcctcccatggggtggaacagctggaaccatttccactgcaacatcaacgagcagctcatcagagagactgctgatgcattggtgcatactggacttgcagggttgggttatcgctacgttaacatagatgattgctggggagaagccaatagagactaccagggaaatttagttgctaagcgatcaacatttccttccggaataaagtctcttgcagattacgtgcatgcaaaagggctgaagcttggaatctatagtgatgcagggtcacagacatgcagcagaactatgcctgggtcactcggatatgaacaacatgatgcaacgacgtttgcctcctggggggttgattacttgaagtatgacaactgcaacaaccctggtactaggccaagagaaaggtatgccaagatgagctacgctcttcggaattctggaaggaacattttcttctccctttgcgagtggggtgatgataacccagcaacctgggcgagcggtataggcaacagttggaggacaacaggcgacatctacgatagctggggcagcatgacatcgcgcgccgatgagaacaacagatgggcatcctatgccgggcctggtggttggaatgatccagacatgctggaagtaggaaatggtggcatgtcaacggaggagtatcgatcgcattttagtatatgggcattggtcaaggctcctttgttgattggatgtgatgtgaggacgattagcggagatgcattggagatactgagcaactcagaggtcattgcagtcaatcaagactaccttggagttcaagggaagaaggtattcggtggaggcagcgaagaggtttgggcaggtcggttgagtggagggaaggtggctgtggtcctctggaacagaggaagctcgcgggcgacgatcacagcgagatggtccgacatcggcctctcgtcctccaccgccgtcagtgttcgtgatctttgggcgcgtgcgaccatcgggtccgttcgagggcagctcgctgctacggtggctcctcatgcgtgcaagatgtacgttctgacgccgcggtagagccaaggcttgggagtagtgcagacgtgcgcaagcccagtctgcaccagtatgcactgcaactatgtaggatgtgattccactagtaattgcatgaacaagattctaaatacgagatctctgcacagagacaatcctcctccccctcctcctcctcctcctcatcttgaactctgtccgtgaaggctaaaataagagaagatcatcgagtttccttgttta

SEQ ID NO: 106 - DNA, 1447 bp, Musa acuminata
ggtgtgtggcttcggttgggagttgaggatggctcgagttgcaggtgaagcaacaatgacgtctctcctactcctcctcctcttgctaccgacggcagcaaccggaggcagagtcaccaaaggttgggaatcggcggtggagacgaggagaagcgtgttggacaatggcctcggcacgactcctcccatggggtggaacagctggaaccatttccactgcgacatcaacgagcagctcatcagagaaacagcggatgcgctggtgtccaccggacttgccgaactgggttatcaatacgtcaacatagacgactgctggggagaaaactaccgggactctcagggcaatttagttgcgaagcagtcaacattcccctctgggataaactctcttgcagattacgtgcatggaaaaggacttaagcttggaatctacagtgatgcagggacacagacatgcagcaagacaatgcctgggtcactgggatatgaagatcaagatgctcaaacatttgcctcttggggtgttgattacttgaagtatgacaactgcaacaaccctggtaccagcccaagagaaaggtactctaagatgagcagtgctcttcagaattcaggaagggacatcttcttctctctctgtgaatggggagtagatgacccagcaacttgggcgagcagtataggccacagttggagaacaacaggagacatcttcgacagttgggacagcatgacatcccgtgctgatgagaatgacaaatgggcatcttatgcaaagcctggaggctggaatgatcccgacatgctcgaagtagggaatggtgggatgacgacagaggagtaccgatcgcattttagtatatgggcgttggcaaaggctcctttgttgatcggatgtgatgtaagatctattagcgaagatgcattagagatactgagcaactccgaggtcattgctgttaatcaagattcacttggagttcaagggaagaaggtagtgtggggaggcggtacagaggtttgggcaggcccgctcagtggagggacggtggccgtggtcctctggaaccgcggaagttcaccggcgacgatcaccgccgaatggtccgatataggcctctcgtcgtcgaccgtcgtcaatgctcgtgatctttgggcacattcggatactgcatccgttcaaggggagctgactgctacggtggattctcatgcttgcaagatgtacgttctgacgccgcagtaggccgctctgctttcaccaaacatggagagacaattatagcagatctgaagagaattttgaacacattggagagacaatgctacttctacatgtgatccaagatgtaatgcatgttcctgtaatttgctatgtcattccattagtatacttggtgactacacaattattggatgattaatggcgagagagacggaaaac

SEQ ID NO: 107 - DNA, 1459 bp, Musa acuminata
aatagggtgtgtggcttcggttgggagttgaggatggctcgagttgcaggtgaagcaacaatgacgtctctcctactcctcctcctcttgctaccgacggcagcaaccggaggcagagtcaccaaaggttgggaatcggcggtggagaggaggagaagcgtgttggacaatggcctcggcatgactcctcccatggggtggaacagctggaaccatttccactgcgacatcaacgagcagctcatcagagaaacagcggatgcgctggtgtccaccggacttgccgaagtgggttatcaatacgtcaacatagacgactgctggggagaaaactaccgggactctcagggcaatttagttgcgaagcagtcaacattcccctctgggataaactctcttgcagattacgtgcatggaaaaggacttaagcttggaatctacagtgatgcagggacacagacatgcagcaagacaatgcccgggtcactgggatatgaagatcaagatgctcaaacatttgcctcttggggtgttgattacttgaagtatgacaactgcaacaaccctggtaccaacccaagagaaaggtactctaagatgagcagtgctcttcagaattcaggaagggacatcttcttctctctctgtgaatggggagtagatgacccagcaacttgggcgagcagtataggccacagttggagaacaacaggagacatcttcgacagttgggacagcatgacatcccgtgctgatgagaatgacaaatgggcatcttatgcaaagcctggaggctggaatgatcccgacatgctcgaagtagggaatggtgggatgacgacagaggagtaccgatcgcattttagtatatgggcgttggcaaaggctcctttgttgatcggatgtgatgtaagatctattagcgaagatgcattagagatactgagcaactccgaggtcattgctgttaatcaagattcacttggagttcaagggaagaaggtagtgtggggaggcggtacagaggtttgggcaggcccgctcagtggagggacggtggccgtggtcctctggaaccgcggaagttcaccagcgacgatcaccgccgaatggtccgatataggcctctcgtcgtcgaccgtcgtcaatgctcgtgatctttgggcacattcggatactgcatccgttcaaggggagctgactgctacggtggattctcatgcttgcaagatgtacgttctgacgccgcagtaggccgctctgctttcaccaaacatggagagacgattatagcagatctgaagagaattttgaacacattggagagacaatgctacttctacatgtgatccaagatgtaatgcatgttcctgtaatttgctatgtcattccattagtatacttggagactacacaattattggatgattaatggcgagagagacggaaaacaatatca

SEQ ID NO: 108 - DNA, 1903 bp, Musa acuminata
cacacagtgatcccttatagtggcaggcgacacccccacctcccattcccagctttgtcaacagagacctgctgagccctgactaggaagagagagatcgatgaggaaggagagcttggccttgttgacgaccctcctcctgctgctgctgcttctgccgactaccgagtccaaacttagcagggacgacttcccaccaggcttcatctttggagcaggaacttcggcttaccaggtggagggtgccgctgctaaggatggtaggactccaagtttatgggatacatatactcatgcaggggggatgctggacaatagcacaggagatgtggcttccgatcaataccacaaatataaggaagacgtgaagctaatggctgacacaggactcgactcctacagattctccatctcctggtcgaggcttataccaaatggaagaggagccattaatctaaaaggtctggcttactacaacaatctcattgatgagctattgaaatatggaataaagccgcatgtgacaatctatcatcttgatcttccacaagcacttgaagacgagtatggaggatggctgagccagaaaattgtggaggatttcacagcatttgcagacgtatgcttcagagaattcggtgatagggtgtctcagtggaccaccatcgtcgagcctaacataatagggatggcgtcatatgacaatggagtctttccaccaaacagatgttctaagcctttcggcttactcaattgcaccgtcggtgactccaccaccgagccatacattgcaactcacaacctcttactgtcacacgcctctgttgtctcattgtatagaacaaagtatcaagccatacaaaatgggaggataggattgaatgtgtattctttttggtgttatccattgacaaactccagattagatttccaagcaacccaaagatcattggacttcctcataggctggatcattagccccctggttttcggagactacccaaagatcatgaagaagattgtccgctcgaggctcccttccttcacggaggagcaatccgagcaagtaaagggttcgttcgacttcattggcctaaatcattatcaatcaatctgggtcaaggacaactccaacgcttccaagactgcacctcgtgatttcaacgcagatctctttgccaaattctcattttcaaagaacgacacaccgagcggtcagttaatccctgctgacgtacccatcgatcctgatggcctgccacatatgttggagtatatcagagatgcctatggaaatcctccagtttatatcgaagaaaatggttatggatatggaacaaatgacacaatctacgacgtcgagagggtgaactacttgagtgccttcattagcagcatgctcgatggtattaggaagggagccaatgtgaagggatactacgtgtggtcatttttagatgtcttcgagttcttggctgggtttcaatcacgatttgggctatactatgtcgatttcaaagacgaaaaccttagaagacaacctaagctttctgcactttggtactccgacttcctgaagaagaagaagactggcacgaatataaacaggatgggactgcatgaaagatctcattctcaacagtgactcgagactgttatcatgttgctttggataaagatgaagacatacaattaagttgagccaatgagagtgaagatgcatcatgtttccttcgatcttcactagttttctgctatttgagctgttactactaggatgagctgcatccatggcattaagatgtgatgctataataaaggaggttgatcttgggtgggtcaacattattgtgcttaggtggatgtataagattggctcaaataaatgtgatcaaggttacgt

SEQ ID NO: 109 - DNA, 1965 bp, Musa acuminata
acgatatcgatgtatgactgtcaccaagcgtcttgttcttttccgttgccccacacagtgatcccttatagtggcaggcgacacccccacctcccattcccagctttgtcaacagagacctgctgagccctgactaggaagagagagatcgatgaggaaggagagcttggccttgttgacgaccctcctcctgctgctgctgctgcttctgccgagtaccgagtccaaacttagcagggacgacttcccaccaggcttcatctttggagcaggaacttcggcttaccaggtggagggtgccgctgctaaggatggtaggactccaagtttatgggatacatatactcatgcagggaggatgctggacaatagcacaggagatgtggcttccgatcaataccacaaatataaggaagacgtgaagctaatggctgacacaggactcgactcctacagattctccatctcctggtcgaggcttataccaaatggaagaggagccattaatctaaaaggtctggcttactacaacaatctcattgatgagctattgaaatatggaataaagccgcatgtgacaatctatcatcttgattttccacaagcacttgaagacgagtatggaggatggctgagccagaaaattgtggaggatttcacagcatttgcagacgtatgcttcagagaattcggtgatcgggtgtctcagtggaccaccatcgtcgaacctaacataatagggatggcgtcatatgacaatggagtctttccaccaaacagatgttctaagcctttcggcttactcaattgcaccgtcggtgactccaccaccgagccatacattgcaactcacaacctcttattgtcacacgcttctgtcgtctcattgtatagaacaaaatatcaagccatacaaaatgggaggataggattgaatgtgtattctttttggtgttatccaatgacaaactccagattagatttccaagcaacccaaagatcattggacttcctcataggctggatcattagccccctggttttcggagactacccaaagatcatgaagaagattgtccgctcgaggcttccttccttcacggaggagcaatccgagcaagtaaagggttcgttcgacttcattggcctaaatcattatcaatcaatctgggtcaaggacaactccaacgcttccaagactgcacctcgtgatttcaacgcagatctctttgccaaattctcattttcaaagaacgacacaccgagcggtcagttaatccctgctgacgtacccatcgatcctgatggcctgcaacatatgttggagtatatcagagatgcctatggaaatcctccagtttatatcgaagaaaatggttatggatatggaacaaatgacacaatctacgacgtcgagagggtgaactacttgagtgccttcattagcagcatgctcgatggtattaggaagggagccaatgtgaagggatactacgtgtggtcatttttagatgtcttcgagttcttggctgggtttcaatcacgatttgggctatactatgtcgatttcaaagacgaaaaccttagaagacaacctaagctttctgcactttggtactccgacttcctgaagaagaagaagactggcacgaatataaacaggatgggactgcatgaaagatctcattctcaacagtgactcgagactgttatcatgttgctttggataaagatgaaggcatacgtttaagttgagccaatgagagtgaagatgcatcatgtttccttcggtcttcactagttttctgctgtttgagctgttactactaggatgagatgcatccatggcattaagatgtgatgctataataaaggaggatgatcttgggtgggtcaacattattatgcttaggtggatgtataagattggctcaaataaatgtgatcaaggttacgttcgaccta

SEQ ID NO: 110 - DNA, 1487 bp, Zea mays
agccaacaaacagagctccaactcagaaagcatccgtcccttggcagcagcaacaagctactagctatgtgtgtttagagcgagcgagggaaaaaaaagaaaacatctaagatatactccatcatcttcgtttgattaacccgcccagtaaagccatgggtactaatgatagagcggtcatttctctggtactcctcgtgtgcatcgctagccgctcgtccttgggtgccgctgaaactgacgttgagcagaagcgcttgtcagtcccgttgatgtttgtgttcggtgattcgctggtcgatgtcggaaacaataacttcctgccgccgcctgcaccccgtgctgcatctccgtacggcatcgacttccatgctggcaccgccggcgccgtctcaggacggttcacgaatggctacaaccttgccgatttagtcgcgcgacgtctggggttcaagatgagtccacctgcttacctctcgttgacaccggtatcaaagtttgacctgttcacgtgccgaattggtgccaattacgcgtctggcggatctggcattctcaacaccacgggaaacgggacactcacgctgcagaaacaaatcacgctgttctccaaaactcaagcaagaatgtcgtgggcccgctgcaagctcaggtctatggtatcgaggtccttgttccttgtcagcgccggcggcaatgacttctccgccttcagtgaaatgggcatgggcgaacaagacgccccagcctacatcagtagcatggtctcaacctatgtccagcatatcgacgcgttgtacaagttgggagcacggaggttggggatcctagacgtgccagctatcggctgtaccccaggctccagagtccccatggccaacggcggatgcaacgacgctgccaactctatggcgcagaacttcaacagactcctaaggctcgaggtggcgaaagccgtcgcatcctccatgcccggcatgaaatactccattgcaagcacctacaattttgtcaccgacttgatgaacagccatctagtggctgggctccgggtggtcgacagggcatgctgcggatcgggaaaactgaacgcggcggtcatgtgcgcccagccaaacacgacttactgttcggatcgcgacgactacatgttctgggacatgctacatcctacgcaggcaacaaatgaacgtggggtggtcgccatcttctacggcccgcaggagtacgcggatcccatcaactttgcacagttggccgctgccacagcaaatgatgatgatgatataaatactgctatgaccgcaggcgtctatgccgccatatgataaacactatttatgtctattggcatgcagctgcgacatgtcactacctgagtactatatacgtaattcagttggaataatgtacgttgtgtgcatcatcagtctctctctatatatgctggaaataaaatgaagacaagagaccacaatgttagtatc

SEQ ID NO: 111 - DNA, 1860 bp, Hordeum vulgare
ggactcatcagctcgatcatcgtctcctcaaggcccaagctagctagctccactatgcagaccaccgagcgcatggcgctcaccagtcacctcctggccgtcctcctcggcatcgcagtgccgctgctcttctccccccgtgcagagggtggcgaggtaggcgtgtgctatgggaggatggcgggtaacctgcctgacccgacgtctgtggttcaacttatcaagagaaacggcatcacgatggtgaggatctacgacaccaacccaacggtgctggccgccctggccaacaccgacatcaaggtgacggtggagctgaccaacgaggagctgccgctggtggcggcggacgaaaatgacttcgcgttccggtgggtgcagagcaacgtgaaggcctactatccggccacgctgatcaatggcgtgacgatcgggaacgaggtcttcaaagaggctcctcagcttaactctcagctagtcccggccatgaagaaagtgcatgcggcgttggatcgcctgggcctggcggacgccgtgaaggtgaccacgcccatcgcattcgacgcgctcatgacgtccttccctccctccaagggcgcgttccgggacgacatcgcgctgtcggtgatgagccccatggtcgacttcctgaaacagaccaggtcgtacctcatggtgaatatatacccgtacctcgcgtacctgagtaccccggacatgtctatcgactatctcttgttccgccccaatgccggcgtgcatgaccggaatagcgggcaaacgtactacagcctcttggacgcccagcttgacgccgtgtactatgccatggataagctgccgtcctccagcctgcgggggatgaggaagctcacatcactcgatgaagatgtgctggtgacctgtggtgagattcaccacccaagcaaaggccaccgtggcgtgggaaccctagccaacgcccaagccttcaccgatggactcttgagcaaagtgcttggcggcggtaactcggacccgctcgccacgagtgctgtcggcaccccgcaccgtcccaacgctgatctcagcgtctacatcttcgaactattcaacgagaacaacaagcctgaagacgagcaggacttcggcttgttctaccccaacgagcagcccgtgtacccggtcgacttcgtccatggcggcgccggcaccggtgaaagctactgcgtggccaaggccacggccggggacgcagccttgcaggctgcgctggactacgcgtgcggccatggggcggactgcggcgccatccagccagggaagccctgttacgagcccaacaccaagctcgcgcacgcgtcctacgccttcaacgactactaccagaagaacggccgggccagcagcgcctgcgacttcggcggtgccggcaccattgtcaaccaggcaccatcaggccgctgcgacgcgagctcgagctggtgcgtggcgaactcggcggtgggtgccgagcggctgcagagggcgctggactacgcatgtggccacggcgcggactgcacggacatccaacctggagcacggtgcttcaatcctgacaccaaggtcgcgcatgcgtccttcgcgttcaacgactattaccagcgccatggtcgggccgccggaacgtgcgatttcgccggtgccggtaccattgtccggcaggcaccaaagataggcaactgcgtgctgccgtcaagggcctgaaatgaagaaactgtagccaaggggaagctagctttagtaccacgagactacagattatcctctgctgccagcaaagtctagttttcaaatgtaaagctagataaataaatccatggttttcatcacgtgctt

SEQ ID NO: 112 - DNA, 2150 bp, Aegilops tauschii
aatgtagcaatatttttctccatgtttttaagctagcgttggtgccggctataaattccaccacgcccacgatcactcacaactcatcagctcgatcgtcgccacatttacacactaccgagagcatcgatcgcgctgatgactcgcctcctcatcgtcctcctcggtgccgcattgccgctgctcttctcccttgcagaggggggcgaggtgggcgtgtgctacgggagggtggcgactgatctgccggatccggcgtccgtggtgcaactactcaagaaaaacagcatcaccatggtgaggatatacgacaccgaccccacggtgctgcgctcgctggccaacaccaacatcaaggtgacggtggagctgaccaacgaggagctgccgctcgcggcggccgaccaaaataatttcgcgctccggtgggtgcagagcaacgtgaaggcctactacccggccacgctgatcaatggcgtgacgatcgggaacgaggtcttcaaagaggctagccatctaaactctcagctcgtcccggccatgaagaatgtgcaggcggcgttggctaagctgggcctggcggacgccgtgaaggtgacaacgcccatcgcgttcgacgcgctcaagacgtcgttcccaccatccgccggcgcgttcaaggatgacatcgcactgtcggtgatgagccccatggtcgacttcttgcaacagaccgggtcgtacctcatggtgaacttctatccgtaccttgcgtacctggatacccctggcatgtcaattaactacctcttgttccgccccaataacggcgtgcctgacactgttagcgggcaaacctacttcagcctcttcgacgccgagctcgacgcagtctactatgcgatggagaagctcccgtcgtccagcatgcacgttggggggatgaggaagctcacggcaggaggcggaagcctagacgtccaccaaggagagcacgggcacccaaacaaaggccacaaaggggtgggaaccccacaaaacgcccaagatttcatggctggtctcaccctccaagtgctgcagggtaactctgccaccgccgccgcaaacgggcacgacccgctcgccgccagcgccgtccgcggcaccccgcaccggcccaacgccgatctgaacgtgtacatcttcgccctcttcaacgagaacaataagcccgaagacgagcaggacttcgggttgttctacccgaaccagcaacccgtgtacccgaacccgatcgacttcgttcatggcggcaccatcggcgggcccttgcaggcaagctattgcgtggcgaacgcggcggtcggggacgtggccttgcaggcggcgctagactacgcgtgcggcaacggggcggactgcagcgccatccagtcaggcaagccctgctacgagcccaacaccaagctcgcgcacgcgtcctacgccttcaacgactactaccagaagaacggccgggtcaggagcgcttgcgacttcagcggcgccggcaccattgtgaaccaggcaccatcaggtgcatgcgacccgagcccgagctggtgcgtggcgaacgcggcggtgggcgacacgcgtctgcaggcggcgctggactacgcctgcggccgcggcggcgcggactgcacagacatccagcccggagcacggtgcttcgaccccgacaccaaggtcgcgcatgcgtccttcgcgttcaacagctattaccagcggcgtggcagggccaccggaacgtgcgacttcgccggcgccggtaccattgtccggcaggcaccaaagatcggcaactgcgtcctgccgtcaagggcctgaggtgaagaattaaactagccaatgccaagctttgctaccctacctacgagattaagcaataatcatctgctgtcaacaaagtctagttttcaaagtttagtctggcttggtcctttgagaacgttgcctttttgttcccttagccctgcgtggccagtttcaggtttttatttttatttttttggcttagctactctggcatggccttaacgctataaactgtcatggctttggcttgctccattttaataaaaaaaaaggcaggggggttcattaaaaaagtctacttttcaaatgtaaataaaactagttaagtaaat

SEQ ID NO: 113 - DNA, 840 bp, Aegilops tauschii
cacacctcaggcttccttcttccagcaatggcggctttgaccggggcagcgctcctcctcgccagcctccttgctctcgcagccatcaccagcggcaacaccgaaggtgacatcctctactcgcaaaggcaggcgtggaaggaccccaacaacgtgctgcagagctgggatccgacgcttgtcaacccctgcacttggttccatgtcacctgcaacaacgttaactccgtcatccgagtggacttggggaatgcaggcctctcaggcgccctggttcctggactgggacgaatggtgaaccttcagtacctggagctgtttgggaacaacatcagtggaccgattccagcaaccctcggcaacctgacacgcctggtcagccttgatctctatgacaaccgtctcaccggcgcgataccagcctcgctcgggaacatcgagacgctgcgtttcctgaggctgcatgggaacaagcttgcaggtggaataccggcgtctttgggccgtctgaagaagcttcaggccttggagctccaggaaaacatgctgagcggcacggtgccgctggaggttctctcccttgttcttgtcggggacttgactgagcttaacgttgcaaagaacagtctggccggcactgtcaaatcttctaaaccaagagtagctactgtcatccaggacacgctcaagactacacgtctacacgctgagcagcactgacaacctgaacttttgtaagaataaactgaatgttttttccttctgaaactgctgggagaggctgtagccttctatcccgttaagtgtccggaatttaactccatttctagagagaaaaag

SEQ ID NO: 114 - DNA, 953 bp, Triticum aestivum
gcttccttcttccagcaatggcggctctgaccggtgcagcgctcctcctcgccagcctccttgctcttgcagccatagccagcggcaacaccgaaggtgacatcctctactcgcaaaggctggcgtggaaggaccccaacaacgtgctgcagagctgggatcccacccttgtcaacccctgcacttggttccatgtcacctgcaacaacgtcaacaacgtcaactccgtcatccgagtggacttggggaatgcaggcctctcaggcgccctggttcctggactgggacgaatggtgaaccttcagtacctggagctgtttgggaacaatatcagtggaccgattccagcaaccctcggcaacctgacacgcctggtcagccttgatctctacgacaaccatctcaccggcgcgataccagcctcgctcgggaacatcgggacgctgcgtttcctgaggctgcacgggaacaagtttgcaggtggtataccgtcgtcgttgggccgtctgacgaagcttcaaactttggagcttcaggagaacatgctgaccggcacagtgccgctggaagtcctctctcttgttcttcttggggacttgactgaacttaacgttgccaagaacagtctggccggcactgtcaaatcatctaaaccaagagtagctaccgtcatccaggacacgctcaagactacacgtctacatgctgagcagcactgacaacctgaacttttctaagaataaactgaatgttttttccttttgaaactgctggaagaggctgtagccttttattccgttaagagcccctagcttacatccatttctagagagaaaaagggaaaaggtgaaaggtagttgaatacattgtaatcagtgcaacttcataataatgaatctttctctgcacctttagtgcatatccagtgttatccgtttggtatattcatatct

SEQ ID NO: 115 - DNA, 901 bp, Pseudoroegneria spicata
gcaatggcggctcggaccggagcagccctccttctcgccagcctccttgctcttgcagccatcgccagcagcaacaccgaaggtgacatcctctactcccaaaggcaggtgtggagtgaccccaacaacgtgctgcagagctgggatcccacccttgtcaacccctgcacttggttccatgtcacctgcaacaacatcaactccgtcatccgagtggacttggggaatgcaggcctgtcaggcgccctggttcctgaactgggacaaatggtgaaccttcagtacctggagctctttgggaacaacatcagtgggccgataccagcaaccctcggcaacctgacacgcctcgtcagccttgatctttacgaaaaccatctcaccggcgagataccgacctcgctcgggaacatcaggacgctacgtttcctgaggctgcatgggaacaagcttgcaggtggtataccggcgtcgttgggccgtttgacgaagcttcaaactttggagcttcaggagaacatgctgaccggcacggtgccgctggaagtcctctctcttgttcttgttggggacttgactgaacttaacgttgccaagaacagtctggctggcactgtcaaatcatctaaaccaagagtggctacggtcatccaggacacgctcaagactacacgctgagcagcagtgacaacctgaacttttgtaagaataaactgaatgttttttccttctgaaactgctgggagaggctgtagcctttcattccgttaagagtccggagcttacatccacttctagagagaaaaagggaaaaggcgaaaggtggttgaatgcattgtaaccagtgcgacttcgtaataatgaatctttctctgcacctttagtgcatatccccctgtta

SEQ ID NO: 116 - DNA, 678 bp, Triticum urartu
atggcggctctgaccggtgcagcgctcctcctcgccagcctccttgctcttgcagccatagccagcggcaacaccgaaggtgacatcctctactcgcaaaggctggcgtggaaggaccccaacaacgtgctgcagagctgggatcctacccttgtcaacccctgcacttggttccatgtcacctgcaacaacgtcaactccgtcatccgagtggacttggggaatgcaggcctctcaggcgccctggttcctggactgggacgaatggtgaaccttcagtacctggagctgtttgggaacaatatcagtggaccgattccagcaaccctcggcaacctgacacgcctggtcagccttgatctctacgacaaccgtctcaccggcgcgataccagcctcgctcgggaacatcgggacgctgcgtttcctgaggctgcacgggaacaagcttgcaggtggtatactgtcgtcgttgggccgtctgacgaagcttcaaactttggagcttcaggagaacatgctgaccggcacagtgccgctggaagtcctctctcttgttcttcttggggacttgactgaacttaacgttgccaagaacagtctggccggcactgtcaaatcatctaaaccaagaggtagggatgcatatatttgtgatctgcagctcttgacggattaa

SEQ ID NO: 117 - DNA, 1394 bp, Hordeum vulgare
aaagctagtccgcctgagtggaagagcttgagatcgattgcgaaataaattatctcgggcggaggctcccatggagcatggcgaaggtactctgcaggccagtctacgattcttccataaattcaacctgtcttcacatcttcacaggctgaactttcgttggtgaaaaacgccagttacttgcgcactgttctccacaatagcacaggataaaggtcaacagaggagaaagttcaaagcttcgaggccaagaggaccattctgtgatgtgataccaactagaaccgcatataaggaccccctcgtctagcatctcagtgtgcccaacccaacacacctcaagcttcctccttgcagcaatggcggctctgtccggagcagcgctcgtcctcgccggtctccttgctcttgcagccatcgccagcggcaacaccgaaggcgacatcctctacaggcaaaggcaggagtggaaggacatcaacaacgtgctccagagctgggatcccacccttgtcaacccatgcacttggttccatgtcacctgcaacaacgacaactccgtcatccgagtggacttggggaatgcaagcctctcaggctccctggttcctgaattgggacaaatggtgaaccttcagtacctggagctgtttgggaacaacatcagtggaccgataccagcaaccctcggaaacctgacacgcctggtcagccttgacctctacaacaaccgtctcaccggcatgataccggcctcgctcgggaacatcgggacgctgcgtttcctgaggctgaatgggaacaagttggcaggaggtatacctgcgtcattgggcaatctaacgaaacttcaaactttggagcttcaggagaacatgctgaccggcatggtgccgctggatgtcttatctcttgttctttttggggacttgactgaacttaacgttgccaagaacagtctggccggcactgtcaaatcatctaaaccaagagtagctacaattatccaggacacgctcaagactacacgctgagcagcagtgacaacctgaacttttgtaagaataaactgaatgtcttttccttctgaaactgctgggagaggctgtagccttttatcccgttaagagtccagagcttacctccatttcaggagaaaaaaaaggaaaagtgaaaggtgatttagtactacattgtaatcagtgcgactttgtaataatgaatcttcatgtgcatctttactgcatatccggtgttatccattttgtatactcatatctcgggagagtataggaacccttgaaacagatggctcggtatggtaacaccgttcccttgctgtctgcgaaaagggagcatgttttgaatttatttattttgaattttctaaaaaa

SEQ ID NO: 118 - DNA, 990 bp, Hordeum vulgare
ggtgcccaacccaacacacctcaagcttcctccttgcagcaatggcggctctgtccggagcagcgctcgtcctcgccggtctccttgctcttgcagccatcgccagcggcaacaccgaaggcgacatcctctacaggcaaaggcaggaactgaaggacatcaacaacgtgctgacgagctgggatcccacgcttgtcaacccctgcacttggttccatgtcacctgcaacagcgacaactccgtcgtccgagtggacttggggaatgcaagcctctcaggctccctggttcctgaattgggacaaatggtgaaccttcagtacctggagctgtttgggaacaacatcagtggaccgataccagcaaccctcggaaacctgacacgcctggtcagccttgacctctacaacaaccgtctcaccggcatgataccggcctcgctcgggaacatcgggacgctgcgtttcctgaggctgaatgggaacaagctgacaggaggtatacctgcgtcattgggcaatctaacgaagcttcaaactttggagcttcaggagaacatgctgaccggcatggtgccgctggatttcttatctcttgttctttttggggacttgactgaacttaacgttgccaagaacagtctgtccggcactgtcaaatcatctaaaccaagagtagctacaatcatccaggacacgctcaagactacacgctgagcagcagtgacaacctgaacttttgtaagaataaactgaatgtcttttccttctgaaactgctgggagaggctgtagccttttatcccgttaagagtccagagcttacctccatttcaggagagaaaaagggaaaaagtgaaaggtgatttaatacttacattgtaatcagtgcgactttgtaatgatgaatcttcatgtgcatctttactgcatatccggtgttatccgttttgtatattcatatctcgggagagtaaagaaacccttgacac

SEQ ID NO: 119 - DNA, 730 bp, Aegilops tauschii
tagcatactacacctcaccgttccagcaatggaagctcagaccggagcagcactcctcctcgcctgcctgctcgctcttgcaaccattgccagcagcaacactgaaggcgacatcctttactcgcaaaggcaggtgtggaaggaccccaacaacgtgctgacgagctgggatcccacgcttgtcaacccctgcacttggttccatgtcacctgcaacaacgttaactccgtcatccgagtggatttggggaacgcgggcatctcaggcaccctgattcctcaactgggacaactgaagaacctgcagtacctggagctgtacgcgaacaatatgagtggaccaataccaacaaccctgggcaacctgacacgcctggtcagccttgatctctacgacaaccatctcaccggcgtgataccttcctcgcttggggcagtcgggagactgcgtttcttgaggttgcatgggaacaaactggcgggagttatcccggcgtcgttgggccgtctgacgaagcttgtcgagctggagcttcaggagaacatgctgaccggcacggtgccgctggaggtcctctcccttgttcttgtcggggacttgactgaactaaatgttgcgaaaaacaatctggccggcactatcaaatcttctaaaccaagagtggctactgtgatccaagacacgctcaagactacactctgagcaggaggccaacctgaacttctgcaa

SEQ ID NO: 120 - DNA, 842 bp, Secale cereale
gcagccatcgccagcagcaacaccgaaggtgacatcctctactcgcaaaggcaggcgtggaaggacaccaacaacgtgctgcagagctgggatcccacccttgtcaacccctgcacttggttccatgtcacctgcaacaacgtcaattccgtcgtgcgagtggatttggggaatgcaggcctctcaggcgccctggttcctgaactgggacagctgaagaaccttcagtacctggagctgtttgggaacaacatcagtggaccgataccagcaaccctcggcaacctgacacgcctggtcagccttgatcttcaccaaaaccgtctcaccggcgcgataccggcctcgctcgggagcatcgggacgctgcgtttcctgaggctgcatgggaacaagcttgcaggagtcataccggcgtcattgggcaatctaacgaagcttcaaaccttggagcttcaggagaacatgctgaccggcacggtgccgctggaggtcctctcccttgttcttgtcggggacttgactgaacttaacgttgccaagaacagtctggctggcactgtcaaatcatctaaaccaagagtagctacgatcatccaggacaccctcaagactacacgttgagcagcagtgagcgacaacctgaacttttgtaagaataaactgaatgttttttttccttctgaaactgctgggtgaatgcattgtaatcagtccattccatgtgcattgtaatgcattgtaatcagtgcgacttcgtaataatggatcttcctagtaaagtaaaaaaaaaaaaaaaaagaaaaggagacagacgaagacacgagaggataggggggggg

SEQ ID NO: 121 - DNA, 935 bp, Hordeum vulgare
gatactacaccacattgttccaccaatggcagctcagaccggagcagcgctcctcctcgccggcctcctcgctcttgcaaccattgtcagcagcaacaccgaaggcgacatcctttactcgcaaaggcaggtgtggaaggaccccaacaacgtgctgacgagctgggatccgacgcttgtcaacccttgcacttggttccatgtcacctgcaacctcgacaactccgtcatccgagtggatttggggaacgcgggcatctcaggcaccctgattcctcaactgggacaactgaagaacctgcagtacctggagctgtacgcgaacaatatgagtggaccaataccaacaaccctgggcaacctgacacgcctggtcaccctcgatctctacgacaaccatttcaccggcgctataccttcctcgcttggggcagtggggacgcttcgttttctgaggctgcatgggaacaaactggcgggaggtataccgacgtcgttgggccgtctgacgaagcttgtcgagctggagcttcaggagaacatgctgactggagtggtgccgctggaggttctctctcttgttcttgtgggggacttgactgaactaaatgttgccaagaacgatcttgctggcactgccagatcatctaaaccaagagtggctacggtcatccaggacacgctcaagactacaagctgagaagtagtggcaacctgatcttttgtaagagtaaactgaatgattgtagatgtagttgcaacctgagcttttgtagacctctattcaggcggaaggcggtctgtttcaagaaaaaatagaaggtggaagttgtggttgaatgcattgtaattactagcaaccttttacccgcatatcctgagcaatctgtttggtgtcttcgaatctcactgtaaactataaaaacccttgccac

SEQ ID NO: 122 - DNA, 1035 bp, Hordeum vulgare
taatcgcacacttttctccacaagagcacaagataaaggtcagcagaggagaaaattcaaagctttgggaagacccagagcaccattatccgatctgtaacccactagaactgcttataaggacacgtacaccctcctggtctagcatactacaccacattgttccaccaatggcagctcagaccggagcagcgctcctcctcgccggcctcctcgctcttgcaaccattgtcagcagcaacaccgaaggcgacatcctttactcgcaaaggcaggtgtggaaggaccccaacaacgtgctgacgagctgggatccgacgcttgtcaacccttgcacttggttccatgtcacctgcaacctcgacaactccgtcatccgagtggatttggggaacgcgggcatctcaggcaccctgattcctcaactgggacaactgaagaacctgcagtacctggagctgtacgcgaacaatatgagtggaccaataccaacaaccctgggcaacctgacacgcctggtcaccctcgatctctacgacaaccatttcaccggcgcgataccttcctcgcttggggcagtggggacgcttcgttttctgaggctacatgggaacaaactggcgggagatataccgacgtcgttgggccgtctgacgaagcttgtcgagctggagcttcaggagaacatgctgactggagtggtgccgctggaggttctctctcttgttcttgtgggggacttgactgaactaaatgttgccaagaacaatcttgccggcactgttagatcatctaaaccaagagtggctacggtcatccaggacacgctcaagactacaagctgagaagtagtggcaacctgatcttttgtaagagtaaactgaatgatttttcattctgaaactgttggcagtagatgtagctgcaacctgagcttttgtagacctctattcaggcttacctctgtttcaagaaataatagaaggaggaagttgtggttgaatgcattgtaattactagcaaccttttacccgc

SEQ ID NO: 123 - DNA, 1118 bp, Triticum aestivum
gcatggtagtcaacgacagagtaccccgggggatacagagcacacgtactacacctcacggttccagcaatggcagctcagaccggagcagtgctcctcctcgtcggcctccttgctcttgcaaccatggccagcagcaacactgaaggcgacatcctttactcgcaaaggcaggtgtggaaggatcccaacaacgttctgacaagctgggatccgacgcttgtcaacccctgcacttggttccatgtcacctgcaacctcgacaactccgtcacccgagtggatttggggaacgcaggcatctcaggcaccctgattcctcaactgggacaactgaagaacctgcagtacctggagctatacgggaacaatatgagtggaccaataccaacgaccctgggcaacctgacacgcctggtcagccttgatctctacgacaaccatctcaccggagtgataccttcctcgcttggggcagttgggacactgcgtttcttgaggttgcatgggaacaaactggcagggagtataccggcgtcgttgggccgtctgacgaagcttgtcgagctggagcttcaggagaacatgctgagcggcacggtgccgctggagatcctctcacttgttcttgttggggacttgactgaactgaatgtcgccaagaacaatcttgccggcactgtcatatcatctaaaccaagagtggctacggtcatccatgacacgctcaagactacaagctgaacactagtggcaacctaaacttttgtaagaataaactaaatgatttctaattctgaaatggctggcagtagctgtagctgcggcctgagcttttgtagacctctattctggtaaggctccggggacttacctccgtttcaagaaaaaagaggaagttgtggttgaaagcattgtaattactagcaacctttacccgcatatcctgtgtaatctatttggtgtcgtgtctcactataaactataaaaacccttgccacatgtggcttcccttgctgtgtgctaaagggagcatgttatggccctcagtgtttttgacggcttgaaggctatctaggataatcattatcatcaatggattttatttgaaaacgtct

SEQ ID NO: 124 - DNA, 902 bp, Secale cereale
tggcagccatcgccagcagcaacaccgaaggtgacatcctctactcgcaaaggcaggcgtggaaggacaccaacaacgtgctgcagagctgggatcccacccttgtcaacccctgcacttggttccatgtcacctgcaacaacgtcaattccgtcgtgcgagtggatttggggaatgcaggcctctcaggcgccctggttcctcaactgggacagctgaagaaccttcagtacctggagctgtttgggaacaacatcagtggaccgataccagcaaccctcggcaacctgacacgcctggtcaaccttgatctttaccaaaaccgtctcaccggcgtgataccggcctcgctcgggagcatcgggacgctgcgtttcctgaggctgcatgggaacaagcttgcgggagtcataccggcgtcattgggcaatctaacgaagcttcaaaccttggagcttcaggagaacatgctgaccggcatggtgccgctggaggtcctctcccttgttcttgtcgggacttgactgaactcaacattgccaagaacagtctggctggcactgtcaaatcatctaaaccaagagtagctacgatcatccaggacaccctcaagactacacgttgagcagcagtgagcgacaacctgaacttttgtaagaataaactgaatgttttttccttctgaaactgttgggagaggctgtagccttttatcccgttaagagtctggagcttaactccatttctagagagagaaaagggaaaggtgaaaggtggttgaatgtgttgtaatcagtgcgactttgtaataatgaacattcatgtgcacctttaccgcatatccagtgttatccgttatgtatattcatatctcaggagaatatagaaacccttgactcaaa

SEQ ID NO: 125 - DNA, 405 bp, Triticum aestivum
tgctccacaagttcaggaccaaccaacgatgaagaacagcacgcttgtggcgatcctggtcgtcctccaggccatcatggtcataggaatcctctcacacgccgccgatgacaatttccccaagtgctgcgaccactgcaactcctggtcggggtaccaattctgtgacgacgtcggccccaggtgccgcgacggctgcgtcaactgccacgtggtggagacgagccccgtgaagacgttccggtgtggagatggacgccccgtcctcggcgggcaaggcacgcccacgccctgcccaccaccgtgcaaaaagcattgatcgctagagctcagacagtgagatcgatgttgcgcctaaaacataaaataaaaaggctccgatgagatgagcagagccactcccag

SEQ ID NO: 126 - DNA, 518 bp, Avena sativa
ctgggaagagatttgctccacaagttcaggaccaaccaacgatgaagaacagcacgcttgtggcgatcctggtcgtcctccaggccatcatggtcataggaatcctttcacacgccgccgatgacaatttccccaagtgctgcgaccactgcaactcctggtcggggtaccaattctgtgacgacgtcggccccaggtgccgcgacggctgcgtcaactgccacgtggtggaacgagccccgtgaagacgttccggtgtggagatggacgcccgtctcggcgggcaaggcacgcccacgccctgcccaccaccgtgcaaaagcattgatcgctagagctcagacagtgagatcgatgtagcgactaaacataaataaaggctaccgatgagatgagcagagccactccagcgttctctttccttagagagtataatatagttgattgttagactttaaataaataacgtaggtatacgtagtttgtatataacgtctactgtacttaagtactaaaat

SEQ ID NO: 127 - DNA, 664 bp, Secale cereale
tcagcacaaaaccatcattccacgagcagatcgaccagtttaggagcaaccaacgatgaagagtagcacgctggtggcgatcctggtcctccagaccgtcatggtcatgggaatcctctcacgctcactggccaccaacgacaatttccccaagtgctgcaacaactgcaactcctggtcggggtaccagttctgtgacgacgtcggccccaggtgccgccgcggctgcgccaactgccaggtggtacagacgagccccgtgaagacgttccggtgtggagatggacgccccgtcttcgacgggcacggcacgcccacgccctgcccaccgccgtgcaaaaagcactgatcgctccagctccctcagacactgatgagatcgatgttgcgcccaaaacatcaaataaaaaggctccgatgagatgagcagagccacgcccagcgttctctttcctttcagagagatgttgctttaattaaatataaataaacacgggtatcagtttatatatgcgtctctgcttaatcaaataaaaaacagtttatttgtgcgatatatttgtgctctcaagtgcgcagcggcgagcggagccttctcggtgctcaagcatgtatgtacggctgtcacactcggtgcgagttgaactaattattttttccctga

SEQ ID NO: 128 - DNA, 595 bp, Aegilops tauschii
acacactagcacaacaaaaccatcattccacgagcagatcgacaggactgggagagcacaagtttaggaccaaccaacgatgaagagcagcacgctggtggcgatcctggtcctccagaccgtcatggtcatggggatcctctcacaggccgccgccaaagacaatttccccaagtgctgcgacaactgcaactcctggtcggggtaccaattctgtgaggacgtcggccccaggtgccgccgcggctgcgccaactgccaggtggtgcagatgagccccgtgaagacgttccggtgtggagatggacgccccgtctatgacgggcacgacacgcccacgccctgcccgccgccgtgcaaaaagcactgatcgctccagctccctcagacactgatgagatcgatgttgcggccaaaacataaaataaaaaggctccgatgagatgagatgagcagagccatgcccagccttctctttcctttgagagataataataatatatttgatgttgctttttaagtaaataaataaacacgggtatcagtttatatatgcgtctctgcttaatcaaataaaaaacagtttatttgtgcg

SEQ ID NO: 129 - DNA, 4573 bp, Oryza sativa
caaggcccaagccaaccaccaggcaccggcagcagctagcgtccaaggcctcagcctccgccctccgccgccggcgagcagagccccaattcgccattgctgcggcagtgagtgtagcagtctccaactttatccgtcacagctaaaagttagtccactcaatacactcattgcctcatcatcgtgtcaaattaaagccgtgctttccacgcagattccccggctaaaccggactaaattaagacaaactgagactgaaaagaactcaaatcgataaacgtgagtgaatcggcccgggccacctcatgtggcacttgcgggggaggagctccgtgaccgcagcagcagccgcagcgctacataaaccggtcgcccacctgcgcctcctcctcgcagtctccgcctggtccgtccccgccgcagcctccaacgtcgcggcggcttcgactacgactcgaggcggcccgagccctagcgcgggcgtcgcgcctagagcgatgccttcctcgtcctcctcgccgccttccgccgccgaggggacgaccgctgcagcgggtgggttccgcctcaccgagccctcgttcctcgagtcgctgatgccgaagaaggagatcggcgtcgaccgcttcctcgccgcgcatcccgagtacgacggccgcggcgcgctcatcgccatcttcgattctggagttgatccggctgcagctggtttgcagactacttcagatggaaagcccaagatccttgatgttattgactgcacgggtagtggtgatgttgacacgtccaaagtggtgaaagctgatgatgatggttctattgttggtgcttcaggcacccatctgactataaatccctcatggaagaacccttctcaagagtggcatgttggctgtaaattagtctatgaactcttcacggacacacttacctctcgtttgaagaaagaaagaaagaagaaatgggacgagcacaaccaagaagcaatatctgaggccttgaaacagctgaatgaattcgaaaagaaacacagtaaatctgatgacgccaaacaaaaaatggctcgtgaagacctgcaaagcaggcttgagtacctgaggaaacaagcagaaggttacgatgacagggggccggtaattgatattgttgcatggcacgatggtgatgtgtggagggttgctgttgatacccagggccttgagggcaacaaaaattgtggaaaacttgcagattttgttccattgacaaactacagacttgagcggaagtttgggatttttagcaaattagatgcttgctcttttgtagcaaacatttacgatgatggaaaccttgttagtatagtaactgattgctctcctcatgctacccatgttgcgggcattgcagctgcttttcatcctgatgaacctttgctcaatggagttgcaccgggtgcacaactgatttcctgcaagattggcgatacccgtttaggatcaatggagacagggacaggcctggttagggccttgatagctgcagtagagcacaaatgtgatctgattaacatgagctatggagagcctacccttcttcctgactatggcagatttattgatcttgctagtgaggttgtagacaagcatcgtattatatttattagtagtgctggaaacaatggtcctgctttaaacactgtcggtgctcctggtggtactagttcaagcattattggcgttggcgcttatgtctcaccagctatggctgctggagctcactgtgtcgtacaagcaccagctgaggggatggagtacacatggtctagccgaggtcctactgctgacggggatcttggtgtctccattagtgcaccgggtggagcagtggctcctgtaccaacatggacacttcagtctcgcatgctcatgaatggaacttccatgtcatcaccttctgcctgcggtggggttgctcttcttgttagtgccatgaaggctgaaggcattccattaagcccttatactgtgaggaaggcaattgagaatacagctgcatcaataagtgatgtgcctgaggagaagctaaccacagggcatgggcttttgcaagttgatagggcttttgaatatgctcaacaggctaaggaattgccacttgtttcttatagaatatcaatcaatcaagtgggcaagccaacttctaaacttagaggaatatatctacgtgggagtaacacatgccggcaaacaagtgagtggactgttcaactagacccaaaatttcatgaggatgcaagtaacatggagcaattggttccatttgaggagtgcctgcagctgcattccactgatagctctgtcatcaaaattcctgagtacataatggtgacaaacaatgggcgcactttcaacattgttgtaaatcctgttaatatcagcagcggccttcactattatgaagtttatggtatagattgcaaagcaccatggcgtggacctattttccgcgtaccaatcactgtaataaagcctattgctctatcaggagagccacctgcattgacactttcaaatctttcctttaagtcaggtcacattgaaagaaggttcataaatgtgcctattggagcttcatgggtggaagttacaatgcgcacatcagcctttgatactcctaggaggttctttttggacactgttcagatctgtccactgaagcgacctattaaatgggaggctgttgtcactttctcttcaccttctctcaagaatttcagttttcctgtagaaggtggcttaactttggagttgtccatagcccagttctggtctagcggaattgctagccatgaacctacctgtgttgattttgagattgtgtttcatggaatatccgttgatcagaaaataattggccttgatggtagtgaggcacctgtgcgtgttgttgctagatctctattagcatcagagaggcttgttcctgttgccactctgaacaaggtcaagaccccttatcgaccagtggagtctaatctttgttcacttcctcccagccgtgatagattaccatctggcaagcaaatcatagcactaactctgacttacaaattcaaactagaggatggtgctgaaataaagccccgtgtgcccctacttaacaacagaatatatgataacaagttcgagtctcagtattatagaatatcagattcaaacaagtgtgtctactcttctggtgacgtctatcctaattatgtcaaactctcaaaaggtgaatacacgctgcaattgtacataaggcatgacaatgtgcagttattggagaaactgaagcagttggttctatttatcgagaggaagctagagaaaaaggatttcattcaattgagtttctactctgaacctgatggccctacagttggaaatggcaccttcaaatcctctattttagttccaggagaaccagaagcattctatgtgggtccaccatctagagaaaaacttccaaagaatgttctacctgggtctgttttggttgggtcaattacctatggtgcggtaagctctttcagcaagaaagatgaccaaaaccagcatgctccagcatcttatagtatctcgtatctcattccaccatcaaaggttgataatgataaagaaaagggagtttcatctggaagaaagagtatttcagagagattggatgacgaggttcgagacaccaagataaagttcctttctggctttaatcaagaaactgaggatgacaagtcttcttggacggcacttgttgcttctcttaagccagagtatcccaagtatacacctttgcttgccaaaattttggaatgcatagttcagaaagcaacttcagatgataagtttagccatcaaaaagagattatagctgcagctgatgaggttgtggacagtattgataaagaggatctggcaaagtctttgtcccttaaaccagatcctgaagatgaagaggcacagaaaaataagaaaaagatggaagaaacacgagaccagttggctgatgcactataccaaaagggtcttgcattggcagagattgagtcgctaaagactgatgagtcaactgaggcatctgctaaagatgtttttgaagagaattacaaagaattaattaaatgggttgatgccaaaactacaaaatacggctctttaactgtcctgcgtgagaggcgctgtggaagacttggcactgcattgaaggttctgaatgacatgattcaagatgactctgagcaaccaaagaaaagactttatgatttgaagatccaattgattgaggagataggatgggtccatgtatcggcctacgagaagcagtggatgcatgtccgatttcccccatctttgcctccgttttaattgttaggactatttttcactcatttttcatcaccatggattcagtattttactatttttgtcattgttggtagcaaacttgctggtttggtagtttttcactaggtattttatttcttcaaatggtaataagaacttaagaaggctgcctgctactgctaagctcatcggtttgtgcagttttgtct

SEQ ID NO: 130 - DNA, 4080 bp, Oryza sativa
atgtggcacttgcgggggaggagctccgtgaccgcagcagcagccgcagcgctacataaaccggtcgcccacctgcgcctcctcctcgcagtctccgcctggtccgtccccgccgcagcctccaacgtcgcggcggcttcgactacgactcgaggcggcccgagccctagcgcgggcgtcgcgcctagagcgatgccttcctcgtcctcctcgccgccttccgccgccgaggggacgaccgctgcagcgggtgggttccgcctcaccgagccctcgttcctcgagtcgctgatgccgaagaaggagatcggcgtcgaccgcttcctcgccgcgcatcccgagtacgacggccgcggcgcgctcatcgccatcttcgattctggagttgatccggctgcagctggtttgcagactacttcagatggaaagcccaagatccttgacgttattgactgcacgggtagtggtgatgttgacacgtccaaagtggtgaaagctgatgatgatggttctattgttggtgcttcaggcacccatctgattataaatccctcatggaagaacccttctcaagagtggcatgttggctgtaaattagtctatgaactcttcacggacacacttacctctcgtttgaagaaagaaagaaagaagaaatgggacgagcacagccaagaagcaatatctgaggccttgaaacagctgaatgaattcgaaaagaaacacagtaaatctgatgacgccaaacaaaaaatggctcgtgaagacctgcaaagcaggcttgagtacctgaggaaacaagcagaaggttacgatgacagggggccggtaattgatattgttgcatggcacgatggtgatgtgtggagggttgctgttgatacccagggccttgagggcaacaaaaattgtggaaaacttgcagattttgttccattgacaaactacagacttgagcggaagtttgggatttttagcaaattagatgcttgctcttttgtagcaaacatttacgatgatggaaaccttgttagtatagtaactgattgctctcctcatgctacccatgttgcgggcattgcagctgcttttcatcctgatgaacctttgctcaatggagttgcaccgggtgcacaactgatttcctgcaagattggcgatacccgtttaggatcaatggagacagggacaggcctggttagggccttgatagctgcagtagagcacaaatgtgatctgattaacatgagctatggagagcctacccttcttcctgactatggcagatttattgatcttgctagtgaggttgtagacaagcatcgtattatatttattagtagtgctggaaacaatggtcctgctttaaacactgtcggtgctcctggtggtactagttcaagcattattggcgttggcgcttatgtctcaccagctatggctgctggagctcactgtgtcgtacaagcaccagctgaggggatggagtacacatggtctagccgaggtcctactgctgatggggatcttggtgtctccattagtgcaccgggtggagcagtggctcctgtaccaacatggacacttcagtctcgcatgctcatgaatggaacttccatgtcatcaccttctgcctgcggtggggttgctcttcttgttagtgccatgaaggctgaaggcattccattaagcccttatactgtgaggaaggcaattgagaatacagctgcatcaataagtgatgtgcctgaggagaagctaaccacagggcatgggcttttgcaagttgatagggcttttgaatatgctcaacagactaaggaattgccacttgtttcttatagaatatcaatcaatcaagtgggcaagccaacttctaaacttagaggaatatatctacgtgggagtaacacatgccggcaaacaagtgagtggactgttcaactagacccaaaatttcatgaggatgcaagtaacatggagcaattggttccatttgaggagtgcctgcagctgcattccactgatagctctgtcatcaaaattcctgagtatataatggtgacaaacaatgggcgcactttcaacattgttgtaaatcctgttaatatcagcagcggccttcactattatgaagtttatggtatagattgcaaagcaccatggcgtggacctattttccgcgtaccaatcactgtaataaagcctattgctctatcaggagagccacctgcattgactctttcaaatctttcctttaagtcaggtcacattgaaagaaggttcataaatgtgcctattggagcttcatgggtggaagttacaatgcgcacatcagcctttgatactcctaggaggttctttttggacactgttcagatctgtccactgaagcgacctattaaatgggaggctgttgtcactttctcttcaccttctctcaagaatttcagttttcctgtagaaggtggcttaactttggagttgtccatagcccagttctggtctagtggaattgctagccatgaacctacctgtgttgattttgagattgtgtttcatggaatatccgttgatcagaaaataattggccttgatggtagtgaggcacctgtgcgtgttgttgctagatctctattagcatcagagaggcttgttcctgttgccactctgaacaaggtcaagaccccttatcgaccagtggagtctaatctttgttcacttcctcccagccgtgatagattaccatccggcaagcaaatcatagcactaactctgacttacaaattcaaactagaggatggtgctgaaataaagccccgtgtgcccctacttaacaacagaatatatgataacaagttcgagtctcagtattatagaatatcagattcaaacaagtgtgtctactcttctggtgacgtctatcctaattatgtcaaactctcaaaaggtgaatacacgctgcaattgtacataaggcatgacaatgtgcagttattggagaaactgaagcagttggttctatttatcgagaggaagctagagaaaaaggatttcattcaattgagtttctactctgaacctgatggccctacagttggaaatggcaccttcaaatcctctattttagttccaggagaaccagaagcattctatgtgggtccaccatctagagaaaaacttccaaagaatgttctacctgggtctgttttggttgggtcaattacctatggtgtggtaagctctttcagcaagaaagatgaccaaaaccagcatgctccagcatcttatagtatctcgtatctcattccaccatcaaaggttgataatgataaagaaaagggagtttcatctggaagaaagagtatttcagagagattggatgacgaggttcgagacaccaagataaagttcctttctggctttaatcaagaaactgaggatgacaagtcttcttggacggcacttgttgcttctcttaagtcagagtatcccaagtatacacctttgcttgccaaaattttggaatgcatagttcagaaagcaacttcagatgataagtttagccatcaaaaagagattatagctgcagctgatgaggttgtggacagtattgataaagaggatctggcaaagtctttgtcccttaaaccagatcctgaagatgaagaggcacagaaaaataagaaaaagatggaagaaacacgagaccagttggctgatgcactataccaaaagggtcttgcattggcagagattgagtcgctaaagactgatgagtcaactgaggcatctgctaaagatgtttttgaagagaattacaaagaattaattaaatgggttgatgccaaaactacaaaatacggctctttaactgtcctgcgtgagaggcgctgtggaagacttggcactgcattgaaggttctgaatgacatgattcaagatgactctgagcaaccaaagaaaagactctatgatttgaagatccaattgattgaggagataggatgggtccatgtatcggcctacgagaagcagtggatgcatgtccgatttcccccatctttgcctccgttttaa

SEQ ID NO: 131 - DNA, 4341 bp, Oryza sativa
atgtggcacttgcgggggagctccgctaccaccgcagcggcgctacataaatccgtcgcccacctgcgtctcctcctcgcagtctccgcttggtctggacctggaccgctcctccccgccgccgccgccgccgcggccctcgcggcagtctctactcgccgaggaggcccgggccctagcgcgagggccgtcgcggccagcgcgatgccttcttcttctccgtccacctcgccgccttccgccaaggggacgaccgctgctgcggctccggctgggttccacctcaccgagccctcgttcctcgagtcgctgatgccgaagaaggagatcggcgtcgaccgcttcctcgccgcgcaccccgagtacgacggccgcggcgcgctcatcgcgatcttcgattctggagttgatccggctgcagctggtttgcagactacttcagatgggaagcccaaaatccttgacattcttgactgcacgggtagtggtgatgttgacacgtccaaagtggtgaaagctgatgatgatggttctattgttggtgcttcaggtactcgtctgattataaacccctcatggaaaaacccttctcaagagtggcatgttggctataaattagtttatgaactcttcacggattcacttacctcccgtttgaagaaagaaagaaagaagaaatgggatgaggaaaaccaagaagcaatatctgaggcattgaaacagctgaatgaattcgaaaagaaacaccgtaaatctgatgatgccaaactaaaaatggctcatgaagacctacaaaacaggctcgattacctgaggaaacaagcagaaggttatgatgacagggggccagtaattgatgttgttgcatggcacgatggtgatgtctggagggttgctgttgatacccagggccttgagagcaaccaaaattgtggaaaacttgcagattttgttccattgacaaactacagacttgagcggaagtttgggatttttagcaaattagatgcttgctcttttgtagcaaacatttacgatgatggaaaccttgttagtatagtaactgattgttctcctcatgctacccatgttgcgggcattgcagctgcttttcatcctgatgaacctttgctcaatggagttgcacctggagcacaactgatttcctgcaagattggtgatactcgtttaggatcaatggagacagggacaggcctggttagggccttgatagctgcagtagagcacaaatgtgatctgattaacatgagctatggtgaggctactcttcttcctgactatggcagatttattgatcttgctagtgaggttgtagacaagcatcgcattatatttattagtagtgctggaaacaatggtcccgctttaaacactgtcggtgctcctggtggtactagctctagcattattggtgttggtgcttatgtctcaccagctatggctgctggagctcactgtgttgtacaagcaccagctgaggggatggaatacacatggtctagccgaggccctgctgctgatggggatctcggtgtctccattagtgcacctggtggagcagtggctcctgtaccaacatggacgcttcagtctcgcatgctcatgaatggtacttccatgtcatctccttctgcctgtggtggggttgctctgcttgttagtgccatgaaggccgaaggcattccattaagcccgtatattgtgaggaaggcaattgagaatacagctgcatcaataagtgatgtgcctgaggagaaactaactacagggcatgggcttttgcaagttgatagggcttttgaatatgctcagcaggctaaggagttgccgcctgtttcttatagaatatcaatcaatcaagtggggaagtcaattcctaaacttagaggaatatatctacgtgggagtaacacatgccagcaaacaagtgagtggactgttcaactagacccaaaatttcatgaggatgccagtaatatggagcaattggttccatttgaggagtgcctgcagctgcattccactgatagctctgttgttaaaattcctgagtatataatggtgacaaacaatgggcgcagtttcaacattgttgtaaatcctgttaatatcagcagtggccttcactattatgaagtttatggtatagattgcaaagcaccatggcgtggaccgattttccgtgttccaatcactgtaataaagcctattgctctattaggagagccacctgcattgacactttcaaatctttcctttaagtcaggtcacattgaaagaaggttcataaatgtgccaattggagcttcatgggtagaagttacaatgcgtacatcagcctttgatactcctaggaggttctttttggacgctgttcaaatctgtccactgaagcgacctattaaatgggaggctgttgtcactttctcttcaccttctctcaagaatttcagttttcctgtagatggtggcttaactttggagttgtccatagcccagttctggtctagcggaattgctagtcatgaaccgacctgcgttgatttcgagattgtgtttcatggaatatccatcgatcagagagtaattggccttgatggtagtgaggcacctgtccgcatagttgctagatctctattagcatcagagaggcttgttcctgtcgccactctgaataaggtgaagaccccttatcgaccagtggagtgtaatctttgttcactgcctacgagccgtgatagattaccatctggcaagcaaatcattgcactaactctaacttacaaattcaaactagaggatggtgctgaaataaagcctcatgtgcccctacttaacaacagaatatatgataacaagtttgagtctcagttctacagaatatcagattcaaacaagtgtgtatactctagtggtgatgtttatcctgattatgtcaaactttcaaaaggtgaatacacactgcaattgtacataaggcatgacaatgtgcagttattggagaaaatgaagcagttggttatatttattgagaggaagctagagaaaaaggattgcattcaattgagtttctactctgaacctgatggccctgtagttggaaatggcaccttcaaatcctctgttttagtcccaggagaaccagaagcattttatgtgggtccaccatctggagaaaaacttccgaagaatgttctacctgggtctcttttggctgggtcaataacctatggtgccgtaagctctttcaacaagaaagatgaccaaacccagcatgctccagcatcttactgtatctcgtatctcattccaccatcaaaggttgataatgataaagaaaagggtgtttcagctggaagaaagagtatttcagagagattggacgaggaggttcgggacaccaagataaagtttctttctggatttaatcaagaaaccgaggatgacaagtcttcctggatggagcttgttgcttctcttaaggcagagtatccaaaatatacacctttgcttgccaaaattttggaatgcattgttcagaaagcaacagatgataaaattagccatcaaaaagagattattgctgcagctgatgaggttgtggacagtattgataaagaggatctggcaaagtctttgtcccttaaaccagatcctgaagatgatgaggcgcagaaaaataagaaaaacatggaagaaacacgagaccagttggctgatgcactataccaaaagggtcttgcattggcagagattgagtcactaaagactgatgagtcaactgaggcatctgctaaagatgattttgaagagacttacaaagaattgatcaaatgggttgatgccaaatctacaaaatacggttctttaactgtcctgagggagaggcgctgtggaagacttggcactgcattgaaggttctgaatgacatgattcaagatgactccgagcaagcaaagaaaaaactttacgatttgaagatccagttggttgaggagataggatgggcccatgtatcagcttacgagaagcagtggatgcatgtccgatttcccccatctttgcctccgttttaattattaggagtatctttcactcatttctcagcaccaatagattcaatattatgtcattgttggtatcaacttgctggtttggtagcctttcacgacgatttttcttttcaaatggtaataagaaggccatcctctacctctagctcaactttctgatatgtgcaatcttggctcctattccaattcctcgtttcaaatgattgaggacatcagttatcaattgtcctgcgtgaacttactgtc

SEQ ID NO: 132 - DNA, 4536 bp, Brachypodium distachyon
ctcacggtcgcttctcagcgggcgttgagcatagtctccattgctgctctggtgcatcagctctggtatatccccaatccacccactcccattgcctcatcatcatttcacaagcaaaagcattccacgcagattccgcaccgaactgaacattggcaacagcaccacaatacaaacagcaaaaatccgttggaaagtgtaaaggaaggaaggaaggaagcgtaatgttgcacgggagctgcgcaaccgcagccgcgcccctacataaacccgtcgcccacctgcgggtcttcctcagagtctccgcctgtgccacttccgcatcactccccaccgtcgcggctgtttcgactcggagcccgagcccgagccctagcacaggcgtcgcggccaccgcgatgccttcttcgtcctcctcgccgacgccgacgccacccgccgaggagacgaccgccgccgcgattgggttccacctcactgagccctcgtttctcgagtcgctgatgccgaagaaggagaccggcgtcgaccgcttcctagccaagcaccccgagtacgacggccgcggcgcgctgatcgccatcttcgattctggagttgatccggcagcagctggattgcagactacttctgatgggaagcccaagattcttgacgttattgattgcacgggtagtggtgacgttgacacatccaaagtggtgaaagctgatgctgacggtgctatagttggtgcttcaggcactcgtttggttgtaaaccccttatggaagaacccttctgaacagtggcatatcggttgcaaattagtatatgaactctttacagacacactcatatctcggttgaagaaagaaagaaaaaagaaatgggatgaagaaaaccaagaagcaatatctggggctctgagccagctgaacgaatttgaaaagaaacacagtaagcctgatgatgccaaactgaaaatggctcatgaagacctacaaaataggcttgattgcctgaggaaacaagcagaaggttatgatgatagggggcctgtgattgatgttgtcgtatggcatgatggtgatgtgtggagggttgcagttgatactcaggggcttgagggtgacaaaaattgcggaaaattagcagattttgttccattgacaaactacaggcatgagaggaagttcggaatttttagcaaattagatgcatgctcttttgtagcaaatgtgtacgatgatgggaacctcgtcagcatagtaactgattgctctccacatgctacccatgttgcaggcattgcagctgcttttcatcctgaacaacctttgcttaatggagttgcacctggagcacaattgatttcctgtagaattggagatacccgcttaggatcaatggagacaggaacaggtttggttagggccctgatagctgcagtagagcacaaatgcgatctgattaatatgagttatggtgagcctactcttcttcctgactatggaagattcattgatcttgttaatgaggttgtagacaagcatcgtattatatttattagtagtgctggaaacaatggtcccgctttaaacactgttggtgctcctggtggtactagttcaagcattattggtgttggtgcttatgtctcaccagctatggctgctggagctcactgtgtcgtacaacctccatcggaggggatggaatacacatggtcaagtcgaggccctactgctgatggggatcttggtgtctccattagtgcgcctggtggagcagtggcccctgtaccaacatggacacttcaatctcgcatgctgatgaatggtacttccatgtcatctccttctgcctgtggtggggttgctcttcttgttagcgccatgaaggctgaaggcatcccattaagcccttacactgtgagaaaggcaattgagaatacagctgcatctataagtgatgtaccagaggagaaattgactacagggcatggacttttgcaagttgatagggcttttgaatatgcacggcaggctaagaagttgccacttgtttcctacagaatctcagtcaatcaagtagggaagtcaattccaagactaagaggaatatatctacgtggtagtaatgcatgccaacagacgagtgagtggactgttcaacttgatccaaaatttcatgaagatgccagtaatttggagcaattggttccatttgaagagtgcttgcagctgcattccactgatagctcagttgttaatattcctgagtatatattgttgacaaacaacgggcgcagtttcaatattgttgtaaatcctgctaatatcagcagtggtcttcactactatgaagtttatggaacggattgcagagcaccttggcgtggacccattttccgagtgccaattactgtaataaagcctattgctctatcgggggaacctccagtattaacgctttccaaactctactttaaatcagggcatattgaaaggaggttcataaatgtgcctattggagcttcgtgggtggaagttaccatgcgcacatcagactttgatactccaagaagattctttttggatactgttcagatatctccactgaagcgacctattaaatgggaggctgttgttactttctcttcaccttctctcaagaatttcagttttcctgttgaaggtggcttaactttggagttgtctatagcccagttctggtctagtggaattgctagccatgaacctacctgtgttgatttcgagattgtgtttcatggaatatccgttgatcagaaagtaattgcccttgatggcagcgagtcacctgtgcgtattgttgctagatcactattagcatcagagaagcttgttcctgttgccactctgaacaagatcaagataccttacagaccagtggattgtaatttttgtccacttcccaccactcgtgatagattaccgtctggcaagcaaattattgcactgactttaacttacaaattcaaactagaggacggtgctgaagtaaagccccacctgccacttcttaacaacagaatatacgacaacaagttcgagtctcagttctacagaatatcagattcaaataagtgtatttactcttctggcgatgtctatcctagttatgtcaaacttctaaaaggtgaatacacactgcaattgtacataaggcatgaaaatgtgcaattcttggagaagctgaagcaattagttctctttattgagaggaaactagagaaaaaggatttcattcaattgagtttctactctgaacctgatggccctgtaattggaaatggcaccttcaaatcttctattttagttccaggtgaacctgaagcattctatgtgggtccaccatctggagaaaaatttccgaagagtgctccacctggagctgttttagttggctccataacctatggtatcgtgagctcattcaacaagaacaatgaacaaaaccagcatgctccagcatcttatagtattttatgccccattcctccatcaaaggttgatgatagtaaagaaaaggggggttcgattggaatgaagaaaagtatttctgagcggttaaatgaggaggttcgagataccaagataaagtttctttccagcatcaagcaagaaagtgaggatcagaagtctgcttgggccgagcttgtcgcttctcttaagtcagagtatccaaaatacacacctttgcttgccaaaattttggaatgtgtacttcaggaagcaccttctgatgataagattagccatcacaaagaggttattgttgcagctgatgaggttcaggatagtattgacaaagagcaactggcgaagattttgtctctaaaacccgatcctgaggaggaagagtcacagataactaagaaaaagatggaagaaacacgagaccagctagctgatgcactataccaaaagggtcttgcattggcagagattgagtcgctaaagcctgatgagtcaactgagacatctgctaaagatgcttttgaggagaattacaaagaattaattaagtgggttgatgcaaaatctgcaaaatatggcactctgaccgtcttacgtgagaggcgctgcggaagatttggcacagcattaaaggttctgaatgacatgattcaagatgagtctgggcaaccaaagaaaaagctttacgatctaaagatccagctgattgaggagataggatgggcacacgtatcagcttacgaaaagcagtggatgcatgtccgctttcccccatctttgcctcctttttaagtggttatttttaccatatactccggcaccagtaggtccagtatattctgtcattgttggatcattgcttcatgtttcttccaattgacattttattccttgaaatggtaactgagggatgcaagtactacctcattggattataattgaggccatcgatttgtcagttgtagcataaacttgaggcggaaaggcacattgaaagtaaacatcttctcaaaacgcgcacaggagttacttc

SEQ ID NO: 133 - DNA, 4567 bp, Brachypodium distachyon
gagcatcctcacggtcgcttctcagcgggcgttgagcatagtctccattgctgctctggtgcatcagctctggtatatccccaatccacccactcccattgcctcatcatcatttcacaagcaaaagcattccacgcagattccgcaccgaactgaacattggcaacagcaccacaatacaaacagcaaaaatccgttggaaagtgtaaaggaaggaaggaaggaagcgtaatgttgcacgggagctgcgcaaccgcagccgcgcccctacataaacccgtcgcccacctgcgggtcttcctcagagtctccgcctgtgccacttccgcatcactccccaccgtcgcggctgtttcgactcggagcccgagcccgagccctagcacaggcgtcgcggccaccgcgatgccttcttcgtcctcctcgccgacgccgacgccacccgccgaggagacgaccgccgccgcgattgggttccacctcactgagccctcgtttctcgagtcgctgatgccgaagaaggagaccggcgtcgaccgcttcctagccaagcaccccgagtacgacggccgcggcgcgctgatcgccatcttcgattctggagttgatccggcagcagctggattgcagactacttctgatgggaagcccaagattcttgacgttattgattgcacgggtagtggtgacgttgacacatccaaagtggtgaaagctgatgctgacggtgctatagttggtgcttcaggcactcgtttggttgtaaaccccttatggaagaacccttctgaacagtggcatatcggttgcaaattagtatatgaactctttacagacacactcatatctcggttgaagaaagaaagaaaaaagaaatgggatgaagaaaaccaagaagcaatatctggggctctgagccagctgaacgaatttgaaaagaaacacagtaagcctgatgatgccaaactgaaaatggctcatgaagacctacaaaataggcttgattgcctgaggaaacaagcagaaggttatgatgatagggggcctgtgattgatgttgtcgtatggcatgatggtgatgtgtggagggttgcagttgatactcaggggcttgagggtgacaaaaattgcggaaaattagcagattttgttccattgacaaactacaggcatgagaggaagttcggaatttttagcaaattagatgcatgctcttttgtagcaaatgtgtacgatgatgggaacctcgtcagcatagtaactgattgctctccacatgctacccatgttgcaggcattgcagctgcttttcatcctgaacaacctttgcttaatggagttgcacctggagcacaattgatttcctgtagaattggagatacccgcttaggatcaatggagacaggaacaggtttggttagggccctgatagctgcagtagagcacaaatgcgatctgattaatatgagttatggtgagcctactcttcttcctgactatggaagattcattgatcttgttaatgaggttgtagacaagcatcgtattatatttattagtagtgctggaaacaatggtcccgctttaaacactgttggtgctcctggtggtactagttcaagcattattggtgttggtgcttatgtctcaccagctatggctgctggagctcactgtgtcgtacaacctccatcggaggggatggaatacacatggtcaagtcgaggccctactgctgatggggatcttggtgtctccattagtgcgcctggtggagcagtggcccctgtaccaacatggacacttcaatctcgcatgctgatgaatggtacttccatgtcatctccttctgcctgtggtggggttgctcttcttgttagcgccatgaaggctgaaggcatcccattaagcccttacactgtgagaaaggcaattgagaatacagctgcatctataagtgatgtaccagaggagaaattgactacagggcatggacttttgcaagttgatagggcttttgaatatgcacggcaggctaagaagttgccacttgtttcctacagaatctcagtcaatcaagtagggaagtcaattccaagactaagaggaatatatctacgtggtagtaatgcatgccaacagacgagtgagtggactgttcaacttgatccaaaatttcatgaagatgccagtaatttggagcaattggttccatttgaagagtgcttgcagctgcattccactgatagctcagttgttaatattcctgagtatatattgttgacaaacaacgggcgcagtttcaatattgttgtaaatcctgctaatatcagcagtggtcttcactactatgaagtttatggaacggattgcagagcaccttggcgtggacccattttccgagtgccaattactgtaataaagcctattgctctatcgggggaacctccagtattaacgctttccaaactctactttaaatcagggcatattgaaaggaggttcataaatgtgcctattggagcttcgtgggtggaagttaccatgcgcacatcagactttgatactccaagaagattctttttggatactgttcagatatctccactgaagcgacctattaaatgggaggctgttgttactttctcttcaccttctctcaagaatttcagttttcctgttgaaggtggcttaactttggagttgtctatagcccagttctggtctagtggaattgctagccatgaacctacctgtgttgatttcgagattgtgtttcatggaatatccgttgatcagaaagtaattgcccttgatggcagcgagtcacctgtgcgtattgttgctagatcactattagcatcagagaagcttgttcctgttgccactctgaacaagatcaagataccttacagaccagtggattgtaatttttgtccacttcccaccactcgtgatagattaccgtctggcaagcaaattattgcactgactttaacttacaaattcaaactagaggacggtgctgaagtaaagccccacctgccacttcttaacaacagaatatacgacaacaagttcgagtctcagttctacagaatatcagattcaaataagtgtatttactcttctggcgatgtctatcctagttatgtcaaacttctaaaaggtgaatacacactgcaattgtacataaggcatgaaaatgtgcaattcttggagaagctgaagcaattagttctctttattgagaggaaactagagaaaaaggatttcattcaattgagtttctactctgaacctgatggccctgtaattggaaatggcaccttcaaatcttctattttagttccaggtgaacctgaagcattctatgtgggtccaccatctggagaaaaatttccgaagagtgctccacctggagctgttttagttggctccataacctatggtatcgtgagctcattcaacaagaacaatgaacaaaaccagcatgctccagcatcttatagtattttatgccccattcctccatcaaaggttgatgatagtaaagaaaaggggggttcgattggaatgaagaaaagtatttctgagcggttaaatgaggaggttcgagataccaagataaagtttctttccagcatcaagcaagaaagtgaggatcagaagtctgcttgggccgagcttgtcgcttctcttaagtcagagtatccaaaatacacacctttgcttgccaaaattttggaatgtgtacttcaggaagcaccttctgatgataagattagccatcacaaagaggttattgttgcagctgatgaggttcaggatagtattgacaaagagcaactggcgaagattttgtctctaaaacccgatcctgaggaggaagagtcacagataactaagaaaaagatggaagaaacacgagaccagctagctgatgcactataccaaaagggtcttgcattggcagagattgagtcgctaaaggtgcattatcttccttcacatcttcctgatgagtcaactgagacatctgctaaagatgcttttgaggagaattacaaagaattaattaagtgggttgatgcaaaatctgcaaaatatggcactctgaccgtcttacgtgagaggcgctgcggaagatttggcacagcattaaaggttctgaatgacatgattcaagatgagtctgggcaaccaaagaaaaagctttacgatctaaagatccagctgattgaggagataggatgggcacacgtatcagcttacgaaaagcagtggatgcatgtccgctttcccccatctttgcctcctttttaagtggttatttttaccatatactccggcaccagtaggtccagtatattctgtcattgttggatcattgcttcatgtttcttccaattgacattttattccttgaaatggtaactgagggatgcaagtactacctcattggattataattgaggccatcgatttgtcagttgtagcataaacttgaggcggaaaggcacattgaaagtaaacatcttctcaaaacgcgcacaggagttacttc

SEQ ID NO: 134 - DNA, 5934 bp, Aegilops tauschii
gccgcctcgtcgccgctgctccgcccggtcggcgccagattctcgctgttcagcagcatggccgccgccgcctcctccgcctcctccgtccacgacttcaccgtcaaggatgcaagtggaaaagatgtcgacctgagcacctacaaggggaaggttctcctcattgtcaatgttgcatcccagtgtggcttgaccaattccaactacacggagctcgctcagttgtacgagaagtacaaggaccagggttttgagatccttgctttcccatgcaaccagtttggtgggcaggaaccgggcactaatgaggaaattgttcagtttgcttgcactcgctttaaggccgagtatccaatttttgacaaggttgatgtcaatggtgacaatgttgcacctgtctacaagttcctgaagtccagcaaaggcagtctcttcggggacaacatcaaatggaacttctcaaagttcttggttgacaaggaggggcatgttgtggatcgctatgcgccaaccacctcccccctcagcatcgagaaggatatcaagaagctgctcgcgagttattaagccttgttgctgcatcaactagatgcattggtgcatcacctgaagcttcagtataatgttgtaataaaggccgtgcagtccgatctcgtagttgtatatgacatgtaatggatttcgtggagcgtcttacttctgctgcagagatatcccctctatctgtgtttttgttgtggttgtgatgcatacatgttgttcgtgcctctgtgttaccaatggtgtgttcgttggaaatttttctgtagtttgttttgtccgggctttgctgcaggcgaagtttccgagaacttggaaaaaacacgtctatcttgcgcgaaaactatttacatatagcaatgacatatttgaggatgaagaagaagaagaggaagaaatacaaaaattctcaacactctaatgttcagtttcacagataaatcatcattccaaggccacaaatatctcccacatctctttttggatattccatgtagtatcagccaaattatctattcagcaccagccagactgcccctagccaaccaccggctgccagcctacccctaccacgctcgcggcttcctgcaagcgcttggcacagtctccattgccgctctgctctgctctggtacagcagtgctgccattttcaattccacgcactcatcgccccatcatcatcatcgtcagccatggtttccacgcagatccggcaatcgagctgaacattcggaatccactcatcaaaaataaacaaactccaaaatcagttggaaaaagtgtaaaggaagccagccttcacctaatgtggctcgggagctgcgcaggcagcgcgaccgcagccgcgctacataaacccgtcgcccacctgcggcccctcctcagagtctccgcctgttgctccacccccgcaccgctccacgccaacgcccaccccaccgtcgcggctggtccgacccggggcccgggccccagcgcaggcgtcgcgcccaccgcgatgccgtcttcctcctccgcgccgacgacgccgccgcccgccgaggagacgaccgccgccgcagccgccagtgggttccgcctcaccgagccctccttcctcgagtcgctcatgccgaagaaggagaccggcgttgaccgcttccttgccgcgcaccccgagtacgacggccgcggctcgctcatcgccatcttcgattctggagttgatccggctgcagctgggttgcagaaaacttctgacgggaagcccaagatccttgatgttattgattgcacgggtagtggtgatgttgacacgtccaaagtggtgaaagctgatgctgatggtgctatagttggtgcttcaggcgctcgtttgtctgtaaacccctcatggaagaacccttctcaagagtggcgtgttggctgcaaactagtatatgaactcttcacggacacacttatatctcgattgaagaaagaaagaaaaaagaaatgggatgaagaaaaccaagaagcgatatccggagctctgaagcagctgaacgagtttgaaaagaagcatagtaagccttatgatgctaaactgaaaaagtctcaagaagacctgcaaaacagacttgattgcctgaggaaacaagcagatggttttgatgacaggggacctgtgattgatgttgttgtatggcatgatggtgatgtgtggagggttgcagttgatacgcagggacttgaggataagaaagatagtggaaaactagcagattttgttccgttgacaaactacaggattgagcgaaagtttgggatttttagcaaattagatgcttgctcttttgtagcaaatgtgtatgatgatgggaaccttgtcagcatagtaactgactgctctccgcatgctacccatgttgccggcattgcagctgcttttcatcctgaagaacctgtgctgaatggagttgcaccaggggcacaattgatttcttgtagaataggagatacccgcttaggatcaatggagacagggacaggcttggttagggccttgatagctgcagtagagcacaaatgcgatctgattaatatgagctacggtgagcctgctcttcttcctgactatggaagattcattgatattgtcaatgaggttgtcgacaagcatcgtattatatttattagtagcgctggaaacaacggtccggctttaaacactgttggtgcacctggcgggactagttcaagcattattggtattggtgcctatgtctcaccagctatggctgctggagctcactgtgtcgtacaacctccgtcggaggggatggagtacacatggtctagtcgaggtcccacagctgacggggatcttggtgtctccattagtgcacctggtggagcagtggcccctgtgccaacatggacccttcagtctcgcatgctcatgaatggtacttccatgtcatctccttctgcctgtggtggggttgctctccttgttagtgccatgaaggctgaaggcattccagtaagcccttatactgtgaggaaggcaatcgagaatacagcttcatctataagtgatgcgcctgaggagaaactgacaacaggacatgggcttttgcaagttgatagggcttatgaatatgcgcggcaagctaagaagttgccacttgtttcttacagaatctcaatcagtcaagtagggaagtcaattccaaaactaagaggaatatatctacgtgggagtaattcatgtcaacaaacaagtgagtggactgttcaacttaacccaaaatttcatgacgatgcgagtaatttggagcaattggttccatttgaggagtgcctgcagctgcattccactgatagctctgttattaatattcctgagtatatattgttgacaaacaatgggcgcagtttcaatattgtcgtcaatcctgttaatatcagtagtggccttcactactatgaagtttatggcatggattgcagagcaccatggcgtggacccattttccgagtgccaatcacaataattaagcctattgctctatcaggagagccgccagtattgtcactttccaaactgtacttcaagtcaggtcatatcgaaaggaggttcataaatgtgccaattggggcctcgtgggcggaagttaccatgcgcacatcagcctttgatactcctagaaggttctttttggatactgttcagatgtgtccactgaagcgacctatcaaatgggagtctgttgttactttctcgtcaccatctatcaagaatttcagttttcctgttgaaggtggcttaactttggaattgtctatagcccagttctggtctagtggaaatgctagccatgaacctacctgtgttgatttcgagattgtgtttcatggaattttcattgatcagaaagtaattgcccttgatggtagtgagtcacctatgcgtattgttgctagatcattattagcatcagaaaggcttgttcctgttgccactctgaacaagatcaagataccttatcgaccagtggattctaacttttgtccgcttcccaccagccgtgatagattaccctctggcaagcaaattattgcactgactttgacttacaaattcaaactggaggacggtgctgaagtaaagccccatctgcccctacttaacaacagaatatacgataataagtttgagtctcagttctatagaatttcagattcaaataagtgtgtttactcttctggtgatgtctatcctagttatgtcaaacttccaaaaggtgaatacacactgcaattgtacataaggcatgaaaatgtgcaaatcttggagaagctgaagcaattggttctatttattgagagaaaactagagaagaaggattgcattcaattaagtttctactctgaacctgatggtcctataattggaaatgccgccttcaagtcctctgttttagttcccggagaacctgaagcattctatgtgggtccaccatctagagaaaaacttccgaagggtgctccacctgggtctgttttagttggctccataacctatggtatagtaagctcattcaacaagaaagatgaacagcatgctccagcatcttatagcattttgtgtatcattccaccatcaaaggttgatgatactaaagaaaagggggtttcagttgaaacaaagaagagtatttctgagaggttaaatgatgaggttcgagacaccaagataaagtttctttcgggccttaaacaagacaatgaggacaacaagtctgcctggaccgagcttgtcgcttctcttaagtctgagtatccaaaatatacacctttgcttgccaaaattttggaatgtgtacttcaggaatcaacctctgatgataaaattagccatcacaaagaggttattgttgcagctgatgaggtcgtggacagtattgacaaagagcaactagcgaaacttttgtctttaaaacccgatcctgaggatgaagaatcacagaaaactaagagaaaaatggaagaaacaagagaccagctagcagatgcactataccaaaaaggtcttgcactggcagagattgagtcgttaaagcctgatgagtcaaccgaggcatctgctaaagatgtttttgaggagaattacaaagaattaattaaatgggttgatgccaaatctacaaaatacggcactctgaccgttttacgtgagaggcgctgtggaagatgtggcacggcactcaaggttctaaacgacatgattcaagaggactctgagcaaccaaagaagaagttatatgatctgaagatccagctgattgaggagataggatgggcacatgtatcggcttatgaaaagcagtggatgcatgtccgctttcccccatctctgcctcccttttaattgggtatgcttaccatttattccggcatcagcaggttcagtactttgtgtcattgttggatgcaacatttgtcatttcagggatcttccatttgacatttcaattcttgaaatggtaataaggcatgcaagcgcggccacattggattctctgttcgtccacttttgcttgcttgtcgaattcttggccgggatgatttaggttatcgattgtagttcctttgagtgaccgcatgattacgctgctcatagcctcgtatacgcctgaactttagtttgagggcatgtatgggcaatagtaaaaccattttcccaaaagatgagctagtagactactccctccgccccaaaataagtgtcttaagtttagtactccctccgtaaactaatataagagcgtttagatcctaatataagagcgtttagatcactattttagtgatctaaacgctcttatattagtttacggagggagtacaagctagtacaaagttgaga

SEQ ID NO: 135 - DNA, 4417 bp, Setaria italica
cggccggcacggtctctccattgttgctccacagctccaaatctccaatgcagcattactcgtatctccactccaatttcccactcatcacctcatcatcgttttcagaagctaagctttccacgcagattccacgattataaagtcgacgaactttcaaattaaaaactcaaatcccggaaacgtgaggtggcaggaccgaatcatgtggccgtcgctacataaacccgtcgcccacgcccacctgcgcctcctcctcgcagtctccgcctgctccggtccactccacttcggcaccaccaccagcgcagtcgcggcggcggttacgactcgaggcccgagcccgagcagcggcgtcgcggccaccgcgatgccttcgtcgtcctcctcgccgccgccgccagccgaggagacgaccgccgccgcctcccccgcgggtgggttccgcctcaccgagccctccttcctcgagtcgctgatgccgaagaaggagatcggcgtcgaccgcttcctcgccgcgcaccccgagtacgatgggcgcggcgcgctcatcgccatcttcgattctggagttgatccagctgctgctgggttgcagactacttcagatggaaaacctaaaatccttgatgttattgattgcaccggtagtggtgatgttgacacatccaaagtggtgaaagctgatgctgatggtgctattgttggtgcttcaggtgctcgtttggttgtaaactcctcgtggaagaacccttctcaagagtggcatgttggctgtaaattgatatatgaactgtttacttatacacttacatctcgattgaagaaagaaagaaagaagaaatgggatgaggaaaaccaggaagcaatttctgatgctctgaagcagctgaatgaatttgaaaagaaacacactaagcctgatgatgccacgctgaagaaggctcatgaagacttgcaaagcagacttgattacctgaggaaacaagctgaaggttatgatgacaagggacctgtgattgatattgttgcatggcatgatggtgatgtttggagggttgctgttgatacccaaacccttgagggtaaaaataatggcggaaaactagcagactttgttccgttgacaaactacaggcttgaacgaaaatatgcaatttttagcaaattagatgcttgctcttttgtagcaaacatttacgatgatgggaacctcgttagtatagtaactgactgctctccgcatgctactcatgtcgcgggcattgctgctgcatttcatccagatgaacctttgctgaatggagttgcacctggagcacaattgatttcgtgtaagattggagacacccgcttaggatcaatggagacagggacaggcctggttagggccttgatagctgcagtagagcacaaatgtgatttgattaatatgagctatggagagcctacaattcttcctgactatggcagattcattgatctttctaatgaggttgtggacaagcatcgtattatattcattagtagtgctggaaacagtggacctgctttaaacactgttggtgctcctggtgggactagtacaaccataattggtgttggtgcttatgtttcaccagctatggctgctggagctcactgtgttgtacaaccaccagctgaggggatggaatacacctggtctagccgaggccctactgctgatggggatcttggtgtctccattagtgcacctggtggggcagttgctcctgtaccaacttggacgcttcaatctcgcatgcttatgaatggcacttccatggcatctccttctgcctgtggtggggtagctcttcttgttagcggcatgaaggccgaaggcattccattaagcccttattctgtaaggaaagcaattgagaatacagctgcatgtataagtaatgcacctgaggagaaactgactacaggaaatgggcttttgcaagttgatagggcttttgaatatacacagcacgcaaagaagttgccacttgtttcttatagaatctcaatcactcaagttggaaagtcaattcctaaattaagaggaatataccttcgggggagtaatgcatgtcaccaaacaagtgagtggactgttcaacttgaccctaaatttcatgaggatgccagtaatctggagcaattggttccttttgaggagtgcctgcagctgcattcaactgatacctctgttattcaaattcctgaatatatattggtgacaaacaatgggcgcagtttcaacattgttgtcaatcctgctaatatcagcaatggccttcactattatgaagtttatggcatagattacaaagcaccgtggcgtggacccattttccgcgtgccaattactgtaataaagcctattactctactgggagagccaccattattgtcaattacaaacctttcgtttagatctggtcatattgaaaggaggttcataaatgtgccttttggagcttcatgggcagaagttaccatgcggacatcagcttttgatactcctagaaagttctttttggacactgttcagatctgtccactgaagcgacctatcaaatgggaggctgctgttagtttctcttcaccttcttcaaaaaatttcagttttcctgtagaaggtggcttaactttggaattgtcaatagcccagttctggtctagcggaattgctagccacgaacctacttgtgttgattttgagattgtgttccatggaatatgcattgatcagaaagtaattgcccttgatggcagtgagtcacccttgcgtatagttgctagatcacttctagcatcagagaagcttgctcctgttgccacccttaacaagatcaagacgccttatcgacctgtggagtgtaatctttcttcacttcccactgaccgtgatagattaccctctggcaagcaagttattgcactgaccttaacttacaagttcaaactagaggacagtgctgaagtaaagccccacgtgccactacttaacaacagaatatatgacaacaagtttgagtctcagttttatagaatatcagattcaaacaagcgtgtttactcttctggcgatgtctaccctagttatgtcaaactttcaaaaggagaatacacactgcaactgtacataaggcatgagaatgtgcaattcttggagaaactcaagcaattggttctgtttattgagaggaaactagataaaaaggatttcattccattgagtttttactctgaacctgatggccctatagttggaagtggcaccttcagatccacaattttagttccaggagaacctgaagcattctatgtgagtcctccatctagagaacaactcccaaagaatgctccacctggggctgttttggttgggtccataacctatggtactgtaagcacatttaacaagaaagatgaccaaaaacagcatgctccagtatcttacaatatctcgtatagcattccaccatcaaaggttaatgatgataaagaaaagggggtttcagttggaacaaagagcatatctgagcagttagttgaggaggttcgggacaccaagataaagtttctttccagccttaagcaagaaactgaggaggacaagtctgcctggtcggagcttgttgcatctctgaagtcagaatatccaaaatatacacccttgcttgctaagattttggaatgtgtactccggaaagcaaatgacgataagattggccatgaaaaagaggttattactgcagctgatgaggttgtggacagtatcgataaagaggaacttgcaaagtatttatatctaaattcggaccctgaagacgaagaagcccagaaatttaagaaaaaactggaagaaacacgggatcagttcgctgatgcactataccagaagggtcttgcattggcagagattgagtcactaaagtctgatgaatctatcgaggcatcttctaaagatatttttgaggaaaattacaaagaattgattaaatgggttgatgctaaatctgctaaatatggcactctgactgtcttgcgtgagagacgctgtggaaggcctggtacagcattgaaggttctaaatgacctgattcaaaatgaatctgaaccgaagaaaaagctctatgatttgaagatccagttgatcgaggaaatgggatggagccatgtttcaacctacgaaaagcagtggatgcaagtccgctttcccccaactctgcctccgttttgattatcaacccatatctttactatcattctctagaatcagttcaattgttgccattgttacatcagttgattgtttcgatggtcatttacttggcattttctcttaaatagtaataatataaagggcatataggcaagctacatgatttttgtgtta

SEQ ID NO: 136 - DNA, 4545 bp, Sorghum bicolor
ggtctctccattgttgctcccagctccaatgcagcattactcgtctccattctctcttccaattttccacttatttatctcatcatcgtttccaagagcaaagctttccacgcagattccacgattaaattaggccaactttttttgaattaaaaactcaaatcctgtaaaacgggatgtggtagcctggcaggagccggactaatcatgtgggcgtcgttacataaacccgtcgcccacgccaacctgcatctcctcatcgcagtctccgcctgttccggaccacttcacttcggcaccgccagcgctgtcgcggcggcgcttacgacccgacgctcgagtcctagcaggggcgtcgcggccaccgcgatgccttcgtcgtccccgtctccgcctccaccagccgaggagacgaccgcctctgctgccgctccggcccctgcgggcgggttccgcctcaccgagccctcgttcctcgagtccctcatgccgaagaaggagatcggcgtcgaccgcttcctcgccgcgcaccctgagtacgacgggcgcggcgcactcatcgctatcttcgattccggagttgatccagctgctgctgggttgcagactacttcagatggaaagcctaaaatccttgatgtacttgattgcactggtagtggtgatgttgacacgtccaaagtggtgaaagctgatgctgatggtgctattgttggtgcttcaggtgctcgtctggttataaactcctcatggaaaaacccttctcaagagtggcatgttggctgtaaattaatatatgaactgtttactgacacacttatatctcgattgaagaaagaaagaaagaagaaatgggacgaggaaaaccaggaagcaatttctgatgctctgaagcagctgaatgaatttgaaaagaagcatcctaagcctgatgacactgtgctgaagaaggctcatgaagacctgcaaagcagacttgattacctgaggaaacaagctgaaggttatgatgataagggacctgtaatcgatattgttacatggaatgatggtgatgtgtggagggttgctgtcgatacccagacccttgagggtaacaatgatggtggaaaactagcagattttgttccactgacaaactacaggcttgaacgtaaatatgcaatttttagcaaattggatgcttgctcttttgtagcaaatgtttataatgatgggaaccttgttagtatagtaactgactgctctccccatgctactcatgtcgcgggcattgcagctgcatttcatccagatgaacctctgctgaatggagttgcgcctggagcacaattgatttcctgtaagattggagacactcgcttaggatctatggagacagggacaggcctggtgagggccttgatagctgcagtagagcacaaatgtgatctgattaacatgagctatggagagcctacccttcttcctgactatggcagattcattgatctttctaatgaggttgtggacaagcatcgtattatattcattagtagcgccggaaacaatggaccggctttaaacactgttggtgctccaggtgggactagtacaagcattattggtgttggtgcttatgtttcaccagctatggctgctggagctcactgtgttgtacaaccacctgcaaagggaatggagtacacatggtctagccgaggccctactgctgatggtgatcttggcgtctccattagtgcacctggtggtgcagttgctcctgtaccaacttggacgcttcaatctcgcatgctaatgaatggcacttccatggcatctccttctgcctgtggtggggtagctcttcttgttagtggcatgaaggctgaaggcattccattaagcccttattctgtgagaaaagcaatagagaatacagctgcatctataagtaatgcacctgaggagaaactgaccacaggaaatgggcttttgcaagttgatagggcttttgaatatgcacagcaggctaagaagttgccacttgtttcttatagaatctcaatcaatcaagtgggaaagtcaattccaaaactaagaggaatatacctccgcgggggcaatgcatgccgccaaacaagtgagtggactgtgcaacttgacccaaaatttcatgagggtgcaagtaacttggagcaactggttccttttgaggagtgcctgcaactgcattccactgatacctctgtggttcaaattcctgagtatatactggtgacaaacaatgggcgcagtttcaacattgttgtcaatcctgctaatatcagcagtggccttcactattttgaagtttatggcatagattacaaagcaccatggcgtggacctattttccgtgtgccaattactgtaataaagcctattactctattgggagagccaccactattgtcaatttcaaacctttcttttcagtctggtcatattgaaaggaggttcataaatgtaccttttggagcttcatgggcggaagttactatgcgaacatcagcttttgatactcctagaaggttctttttggatactgttcagatctgtccactgaagcggcctgttaaatgggaggctgttgttactttctcttctccatcttcaaagaatttcagttttcctgtagaaggtggcttaactttggagttgtccatagcccagttctggtctagcggaattgctagccatgagcctacctgtgttgattttgagattgtgttccatggaatatccattgatcagaaagtaactacccttgatggcgagtcacccttgcttatagttgctagatcacttctagcatcagagaagcttgttcctgttgccaccctgaacaagatcaggatgccttatcgacctgtggagtgtaatctttcttcgctgcccactgaccgtgatagattgccctctggcaagcaaattattgccctgaccttaacttacaagttcaaactagaagacagcgctgaaataaagccccatgtgccactgcttaacaacagaatatatgacaacaaatttgagtctcagttttatagaatatcagattcaaacaagcgtatttactctactggagacgtttaccctagttacgtcaaactttcaaaaggcgaatacacgctgcaactgtacataaggcatgagaatgtgcaagtcttggagaaactcaaggaattggttctgtttattgagaggaaactagataaaaaggatttcgttccattgagtttctactctgaacctgatggtcctatagttggaagtggcaccttcaaatccactgttttagttccaggcgaacctgaatcattctatgtgggtcctccatcgagagaaaaactcccaaagaatgcttcacctggggctgttttggttgggtcgataacctatggtactgtaagcacatttaacaagaaaggtgaacaaaaccaccatgctccagtatcttatagtatctcatataccattctgccatcaaaggttgatgatgataaagaaaagggggtttcagttggtacaaagagcgtatctgagcagttaaatgaggaggttcgagacaccaagataaagtttctttccagtgttaagcaacaaactgaggaggacaagtctgcctggtcggagcttgtggcttctctgaagtcagaatatccaaagtacacacctctgctttctaagattttggaatgtgttctccagaaaggaactgatgatgataagattagccatgaaaaagaggttattgctgcagccgatgaggttgtgggcagtattgataaagaggaactggccaagtatttatctctaaattcagatcccgaagatgaagaagcacagaaattcaagaaaaaaatggaagaaacacgggatcagttggttgatgcactatatcaaaaatgccttgcattggcagagatagagtcactgaagtctgatgagtcaattgagacatctgctaaagacatttttgaggagaattacaaagaattgatcaaatgggttgatgccaaatctgcaaaatatggcactctgactgttttgcgtgaaaaacgctgtggaagacctggtacagcattgaaggttctaaatgatttgattcagaatgaatctgaaccaaagaaaaagctttacgatttgaagatccagttgattgaggagatgggatggacccatgtctcaacctacgaaaagcagtggatgcaagtccgctttcccccaagtctgccaccgttttgatcgtgaactcatatgtttacaaccattctatcatcctgggttcagtagtggtcattttcattgttgggtgcgtcagttcattatttcgatggtcatttgcttacacttcagttttctcgtataaataataatataaaaaagtcaactaggcaagctactggatttgtgcgttatttttttttttcttttgtcatctttcgatcgcaattgactcatttatgtttgtgagagagcatacattatattatgggacgagtaaaaaatgattacgcctta

SEQ ID NO: 137 - DNA, 5069 bp, Brachypodium distachyon
cagcatcggccagaatgacaccctagccaaccaccggcttccagtccgcggagcatcctcacggtcgcttctcagcgggcgttgagcatagtctccattgctgctctggtgcatcagctctggtatatccccaatccacccactcccattgcctcatcatcatttcacaagcaaaagcattccacgcagattccgcaccgaactgaacattggcaacagcaccccaatacaaacagcaaaaatccgttggaaagtgtaaaggaaggaaggaaggaagcgtaatgttgcacgggagctgcgcaaccgcagccgcgcccctacataaacccgtcgcccacctgcgggtcttcctcagagtctccgcccgtgccacttccgcatcactccccaccgtcgcggctgtttcgactcggagcccgagcccgagccctagcacaggcgtcgcggccaccgcgatgccttcttcgtcctcctcgccgacgccgacgccacccgccgaggagacgaccgccgccgcgattgggttccacctcactgagccctcgtttctcgagtcgctgatgccgaagaaggagaccggcgtcgaccgcttcctagccaagcaccccgagtacgacggccgcggcgcgctgatcgccatcttcgattctggagttgatccggcagcagctggattgcagactacttctgatgggaagcccaagattcttgacgttattgattgcacgggtagtggtgacgttgacacatccaaagtggtgaaagctgatgctgacggtgctatagttggtgcttcaggcactcgtttggttgtaaaccccttatggaagaacccttctgaacagtggcatatcggttgcaaattagtatatgaactctttacagacacactcatatctcggttgaagaaagaaagaaaaaagaaatgggatgaagaaaaccaagaagcaatatctggggctctgagccagctgaacgaatttgaaaagaaacacagtaagcctgatgatgccaaactgaaaatggctcatgaagacctacaaaataggcttgattgcctgaggaaacaagcagaaggttatgatgatagggggcctgtgattgatgttgtcgtatggcatgatggtgatgtgtggagggttgcagttgatactcaggggcttgagggtgacaaaaattgcggaaaactagcagattttgttccattgacaaactacaggcatgagaggaagttcggaatttttagcaaattagatgcatgctcttttgtagcaaatgtgtacgatgatgggaacctcgtcagcatagtaactgattgctctccacatgctacccatgttgcaggcattgcagctgcttttcatcctgaacaacctttgcttaatggagttgcacctggagcacaattgatttcctgtagaattggagatacccgcttaggatcaatggagacaggaacaggtttggttagggccctgatagctgcagtagagcacaaatgcgatctgattaatatgagttatggtgagcctactcttcttcctgactatggaagattcattgatcttgttaatgaggttgtagacaagcatcgtattatatttattagtagtgctggaaacaatggtcccgctttaaacactgttggtgctcctggtggtactagttcaagcattattggtgttggtgcttatgtctcaccagctatggctgctggagctcactgtgtcgtacaacctccatcggaggggatggaatacacatggtcaagtcgaggccctactgctgatggggatcttggtgtctccattagtgcgcctggtggagcagtggcccctgtaccaacatggacacttcaatctcgcatgctgatgaatggtacttccatgtcatctccttctgcctgtggtggggttgctcttcttgttagcgccatgaaggctgaaggcatcccattaagcccttacactgtgagaaaggcaattgagaatacagctgcatctataagtgatgtaccagaggagaaattgactacagggcatggacttttgcaagttgatagggcttttgaatatgcacggcaggctaagaagttgccacttgtttcctacagaatctcagtcaatcaagtagggaagtcaattccaagactaagaggaatatatctacgtggtagtaatgcatgccaacagacgagtgagtggactgttcaacttgatccaaaatttcatgaagatgccagtaatttggagcaattggttccatttgaagagtgcttgcagctgcattccactgatagctcagttgttaatattcctgagtatatattgttgacaaacaacgggcgcagtttcaatattgttgtaaatcctgctaatatcagcagtggtcttcactactatgaagtttatggaacggattgcagagcaccttggcgtggacccattttccgagtgccaattactgtaataaagcctattgctctatcgggggaacctccagtattaacgctttccaaactctactttaaatcagggcatattgaaaggaggttcataaatgtgcctattggagcttcgtgggtggaagttaccatgcgcacatcagactttgatactccaagaagattctttttggatactgttcagatatctccactgaagcgacctattaaatgggaggctgttgttactttctcttcaccttctctcaagaatttcagttttcctgttgaaggtggcttaactttggagttgtctatagcccagttctggtctagtggaattgctagccatgaacctacctgtgttgatttcgagattgtgtttcatggaatatccgttgatcagaaagtaattgcccttgatggcagcgagtcacctgtgcgtattgttgctagatcactattagcatcagagaagcttgttcctgttgccactctgaacaagatcaagataccttacagaccagtggattgtaatttttgtccacttcccaccactcgtgatagattaccgtctggcaagcaaattattgcactgactttaacttacaaattcaaactagaggacggtgctgaagtaaagccccacctgccacttcttaacaacagaatatacgacaacaagttcgagtctcagttctacagaatatcagattcaaataagtgtatttactcttctggcgatgtctatcctagttatgtcaaacttcaaaaaggtgaatacacactgcaattatacataaggcatgaaaatgtgcaattcttggagaagctgaagcaattagttctctttattgagaggaaactagagaaaaaggatttcattcaattgagtttctactctgaacctgatggccctgtaattggaaatggcaccttcaaatcttctattttagttccaggtgaacctgaagcattctatgtgggtccaccatctggagaaaaatttccgaagagtgctccacctggagctgttttagttggctccataacctatggtatcgtgagctcattcaacaagaacaatgaacaaaaccagcatgctccagcatcttatagtattttatgccccattcctccatcaaaggttgatgatagtaaagaaaaggggggttcgattggaatgaagaaaagtatttctgagcggttaaatgaggaggttcgagataccaagataaagtttctttccagcatcaagcaagaaagtgaggatcagaagtctgcttgggccgagcttgtcgcttctcttaagtcagagtatccaaaatacacacctttgcttgccaaaattttggaatgtgtacttcaggaagcaccttctgatgataagattagccatcacaaagaggttattgttgcagctgatgaggttcaggatagtattgacaaagagcaactggcgaagattttgtctctaaaacccgatcctgaggaggaagagtcacagataactaagaaaaagatggaagaaacacgagaccagctagctgatgcactataccaaaagggtcttgcattggcagagattgagtcgctaaagcctgatgagtcaactgagacatctgctaaagatgcttttgaggagaattacaaagaattaattaagtgggttgatgcaaaatctgcaaaatatggcactctgaccgtcttacgtgagaggcgcttcggaagatttggcacagcattaaaggttctgaatgacatgattcaagatgagtctgggcaaccaaagaaaaagctttacgatctaaagatccagctgattgaggagataggatgggcacacgtatcagcttacgaaaagcagtggatgcatgtccgctttcccccatctttgcctcctttttaagtggttatttttaccatatactccggcaccagtaggtccagtatattctgtcattgttggatcattgcttcaggtttcttccaattgacattttattccttgaaatggtaactgagggatgcaagtactacctcattggattataattgaggccatcgatttgtcagttgtagcataaacttgaggcggaaaggcacattgaaagtaaacatcttctcaaaacgcgcacaggagttacttcggtgatagttgttctttttctttttttggagagagatgaatactaggtatgctaagggttattgctggggcaagccttggttattaaaaactttaaaataaataatctgattttactttcgatttcaaattttaccatcttgtacccatattaagtgacgaaatattacatgtatctacgtttttgggtataaatacatttatatttgaacaaatttgagtcataaacggagccacggagggagtactacttttcctcttcctgaatttttatcgaagcaagttgttgagaataattatttatgatcaattagattaattattagttagctattaattaggcagttagttatgtaactgttcgtgtcccaaaatttgaaaatttgggacgcgaaggcaaaagtctggaacaccaatgcatgtattggtgcttcttcacctcgtataaatatcatcatcaatcaatggaatagaaca

SEQ ID NO: 138 - DNA, 4131 bp, Secale cereale
cccacgcccaccccaccgtcgcggctggtccgacccgagccccgggccccagcgcaggcgtcgcgcccaccgcgatgccgtcttcctcctccgcgccgacgacgccgccgcccgccgaggagacgaccgccgccgccgccagtggtttccgcctcaccgagccctccttcctcgagtcgctcatgccgaagaaggagaccggcgttgaccgcttcctcgccgagcaccccgagtacgacggccgcggctcgctcatcgccatcttcgattctggagttgatccgtctgcagctgggttgcagaaaacttctgacgggaagcccaagatccttgatgttattgattgcacgggtagtggtgatgttgacacgtccaaagtggtgaaagctgatgctgatggtgctatagttggtgcttcaggtgctcgtttgtctgtaaacccctcatggaagaacccttctcaagagtggcgtgttggctgcaaactagtatatgaactcttcacggacacacttatatctcgactgaagaaagaaaggaaaaagaaatgggatgaagaaaaccaagaagcgatatccggagctctgaaccagctgaatgagtttgaaaagaaacatagtaagcctgatgatgctaaactgaaaaaggcccaagaagacctgcaaaacagacttgattgcctgaggaaacaagcagatggttatgatgacaggggacctgtaattgatgttgttgtatggaatgatggtgatgtgtggagggttgcagttgatacgcagggacttgaggataagaaagattgtggaaaactagcggattttgttccgttgacaaactacaggattgagcggaagtttgggatttttagcaaattagatgcttgctcttttgtagcaaatgtgtacgatgatgggaaccttgtcagcatagtaactgactgctctccgcacgctacccatgttgccggcattgcagctgcttttcatcctgaagaacctttgctgaatggagttgcaccaggggcacaattgatttcttgtagaataggagatacccgcttaggatcaatggagactgggacaggcttggttagggccttgatagctgcagtagagcacaaatgcgatctgattaatatgagctatggtgagcctgctcttcttcctgactatggaagattcattgatattgtcaatgaggttgtcgacaagcatcgtattatatttattagtagcgctggaaacaacggtccggctttaaacactgttggtgcacctggggggactagttcaagcattattggtattggtgcctatgtctcaccagctatggctgctggagctcactgtgtcgtacaacctccgtcggaggggatggagtacacatggtctagtcgaggtcccacagctgatggggatcttggtgtctccattagcgcacctggtggagcagtggcccctgttccaacatggacacttcagtctcgcatgctcatgaatggtacttccatgtcatctccttctgcctgtggtggggttgctctccttgttagtgccatgaaggctgaaggcattccagtaagcccttatactgtgaggaaggcaatcgagaatacagcttcatctataagtgatgtgcctgaggagaaactgacaacaggacatgggcttttgcaagttgatagggcttatgaatatgcgcggcaagctaagaagttgccacttgtttcttacagaatctcaatcagtcaagtagggaagtcaattccaaaactaagagggatatatctacgtgggagtaattcatgtcaacaaacgagtgagtggactgttcaacttaacccaaaatttcacgacgatgcgagtaatttggagcaattggttccatttgaggagtgcctgcagctgcattccactgatagctccgttattaatattcctgagtatatattgttgacaaacaatgggcgcagtttcaacatcgtcgtcaatcctgttaatatcagtagtggccttcactactatgaagtttatggcatggattgcagagcaccatggcgtgggcccattttccgagtaccaatcaccataattaaacctattgctctatcaggagagccgccagtattgtcactttccaaactgtacttcaagtcaggtcatatcgaaaggaggttcataaatgtgccaattggggcctcgtgggcggaagttaccatgcgcacatcagcctttgatactcctagaaggttctttttggataccgttcagatgtgtccactgaagcgacctatcaaatgggagtctgttgttactttctcgtcaccatctatcaagaatttcagttttcctgttgaaggtggcttaactttggaattgtctatagcccagttctggtctagtggaaatgctagccatgaacctacctgtgttgattttgagattgtgtttcatggaatttccattgatcagaaagtaattgcccttgatggtagtgagtcacctatgcgtattgttgctagatcattattagcatcagaaaggcttgttcctgttgccactctgaacaagatcaagataccttatcgaccagtggattctaacttttgtccgcttcccaccagccgtgatagattaccctctggcaagcaaattattgcactgactttgacttacaaattcaaactggaggacggtgctgaagtaaagccccatctgcccctacttaacaacagaatatatgataataagtttgagtctcagttctatagaatttcagattcaaataagtgtgtttactcttctggtgatgtctatcctagttatgtcaaactcccgaaaggtgaatacacactgcaattgtacataaggcatgaaaatgtgcaaatcttggagaagctgaagcaattggttctatttattgagagaaaactagagaagaaggattgcattcaattaagtttctactctgaacctgatggtcctataattggaaatgccaccttcaagtcctctgttttagttcccggagaacctgaagcattctatgtgggtccaccatccagagaaaaacttccgaagggtgcaccacctgggtctgttttagttggctccataacctatggtatagtaagctcattcaacaagaaagatgaacagcatgctccagcatcttatagcattttgtgtatcattccaccatcaaaggttgatgatactaaagaaaagggagtttcagttgaaacaaagaagagtgtttctgagaggttaaatgacgaggttcgagacaccaagataaagtttctttcgggccttaaacaagacaacgaggacaccaagtctgcctggactgagcttgtcgcttctcttaagtcggagtatccaaaatatacacctttgcttgccaaaattttggaatgtgtacttcaggaatcaacctctgatgataaaattagccatcacaaagaggttattgttgcagctgatgaggtcgtggacagtattgacaaagagcaactagcaaagcttttgtctttaaaacccgatcctgaggatgaagaatcacagaaaactaagaaaaaaatggaagaaacacgagaccagctagcagatgcactataccaaaaaggtcttgcactggcagagattgagtcgttaaagcctgatgagtcaaccgaggcatctgctaaagatgtttttgaggagaattacaaagaattaattaaatgggttgatgccaaatctacaaaatacggtactctgactgtcttacgtgagaggcgctgtggaagatgtggcacagcactcaaggttctaaacgacatgattcaagaggactcggagcaaccaaagaaaaagttatatgatctgaagatccagctgattgaggagataggatgggcacatgtatctgcttatgaaaagcagtggatgcatgtccgctttccaccatctcttcctcccttttaattgggtatgcttaccatttatttcagcatcagtaggttcagtactttgtttcattattggatgcaactggtgttgtttcagggatcttccatttgatatttcaattcttgaaatggtaataaggcatgcaagcgctgccacattggattctctgatcgtccac

SEQ ID NO: 139 - DNA, 4146 bp, Avena sativa
ccaagctttacacgcagattccacatccgaacagaacactcgtggaatccatttcaaaataaacaaggcaatccgttggaaaagtgtgaagaaagccacctaataatgtggctcgggagctgcgcgagcagcgcaacagcagccgcgctacataaacccgtcgcccacctgcggcccctcctcagagtctccgcctcctgttcctcctccagcccggcaccgctccacaacgcccccactgtcgcggctcgaggcccgagccctagccccggcgtcgcggccaccgcgatgccttcttcgaactccgcgcccacgacgcccgccgacgagacgaccgccgccgccaccagcgggttccgcctcaccgagccctcgttcctcgagtcgctgatgccgaagaaggagaccggcgtcgaccgcttcctcgccgcgcaccccgagtacgacggccgcggcgcgctcatcgcaatcttcgattctggagttgacccggctgcggctggcttgcagacgacttctgacgggaaacccaagatccttgatgttattgattgcacgggtagcggtgatgttgacacgtccaatgtggtgaaagctgatgctgatggtgctatagttggtgcttcaggaactcgtctgattgtgaactcttcatggaagaacccttctcaagagtggcgtgttggctacaaattagtatacgaactctttacggacacattaatctctcgattgaagaaggaaagaaaaaagaaatgggatgaagaaaaccaagaagcaatatccggagctctgaaccagctgaatgaatttgaaaagaaacatggtaagcctgatgatgccaaactgaaaaaggctaaagaggacctgcaagatagacttgattgtctgaagaaacagtcagatggttatgatgacaagggacctgtgattgatgttgttgtatggcatgatggtgatgcgtggagggttgcagttgatactcaggggcttgagggtaacaaagattgtgggaaactagcagattttgttcccttgacaaactacaggcttgagcggaagtttgggatttttagcaaattagatgcttgctcttttgtagcaaatgtctatgatgatggaaaccttgtcagcatagtaactgattgctctccgcatgctacccatgttgcaggcattgcagctgcttttcatcctgaagaacctttgcttaatggagttgcacctggagcacaattgatttcttgtagaattggagatacccgcttaggatcaatggagacagggaccggcctagttagggccttgatagctgcagtagagcacaaatgcgatctgattaacatgagctatggtgagcctactcttcttcctgactatggaagattcatcgatcttgttaatgaggttgtagacaagcatcgtattatatttattagcagtgctggaaacaacggtcctgctttaaacactgttggtgctcctggtgggactagttcaagcattattggtattggtgcttatgtctcaccagctatggctgctggagctcactgtgtcgtgcaacctccatcagaggggatggaatatacatggtctagtcgaggtccgacagctgatggggatcttggtgtctccattagtgcgcctggtggagcagtggcccctgtaccaacatggacacttcagtctcgcatgctcatgaacggtacttccatgtcatctccttctgcctgtggaggtgttgctcttcttgttagtgccatgaaggctgaaggcattccattaagcccttatactgtgaggaaggcaattgaaaacacagctgcatctataagtgatgtgcctgaggagaaactgactacaggacatgggcttttgcaagttgatagggcttttgaatatgcgcggcaagctaagaagttgccacttgtttcttacagaatctcaatcaatcaagtagggaagtcaattccaaaactaagagggatatatcttcgtgggagtaatgcatgtcaacaaacgagtgagtggactgttcaactgaacccaaaatttcatgaggatgccagcaatttggagcaattggttccatttgaggagtgcctgcagctgcattccactgatagctctgttgtcagtattcccgagtatatattgttgacaaacaatgggcgcagtttcaacattgttgtcaatcccgttaatattagtagtggccttcactactatgaagtttatggcatggattgcagagcaccatggcgtgggcccattttccgagtgccaattactgtaataaagcccattgctctatcaggagagccaccagtattgtcactttccaaactttactttaagtcaggtcatattgaaaggaggttcataaatgtgcctattggggcttcgtgggcggaagttaccatgcgcacatcagcatttgatactcctagaaggttctttttggatactgttcagatgtgtccactgaagcgacctattaagtgggaggctgttgttactttctcttcaccatctctcaagaatttcagtttttctgttgaaggtggcttgactttggagttgtctatagcccagttttggtctagtggaaatgctagccatgaacctacatgtgttgatttcgagattgtgtttcatggaatttccgttgatcagaaagtaattgtccttgatggtagcgagtcacctatgcgtattgttgctagatcattattagcttcagaaaggcttgttcctgtcgccagcctgaacaagatcaggataccttatcgaccagtggagtgtaacttttgtccacttcccactagccgtgatagactaccctctggcaagcaaattattgcactgactttaacttacaaaatcaaactagaggaaggtgctgaaataaagccccatctgcccttacttaacaacagaatatatgataataagttcgagtctcagttctatagaatttcagattcaaataagtctgtttactcttctggcgatgtctatcctagttatgtcaaacttccaaaaggtgactacacactgcaattgtacataaggcatgaaaatgttcaattcttggagaagcttaagcaattggttctatttattgagaggaaactcgagaagaaggatttcattcaattaagtttctactctgaacctgatggtcctatagttggaaatgccacctttaagtcctctattttagttcctggagaacctgaagcattctatgtgggtccgccatctacagaaaaacttccaaagagttctccacctggttctgttttagtgggctccataacctatggtgtagtaagctcgttcaacaagaaagaagaacaaaaccagcatgctccagcttcttatagtattttatgtgtcattccaccatcaaaggtcgatgataataaagaaaagggggtttcagttggaacagagaagagtgtttctgagcggttaaatgacgaggttcgggacaccaagataaagtttctttccagcctcaagaaagaaaaggaagacaagtctgcctggactgagcttgtcgcttctctcaagtccgagtatccaaaatatacacctttgtttgccaagattttggaatgtgtacttcaggaatcaacctctgatgataaaattagccatcacaaagaggttattgttgcagctgatgaggttgtggacagtattgacaaagaggaactggcaaagcttctgtctttaaaacctgatcctgaggacgaagaatcacagaaaactaagaaaaagatggaagaaacgcgagaccagctagcggatgcactataccaaaaaggtcttgcattggcagagattgagtcgctaaagcctgatgagtcaacggaagcatctgctaaagatgtttttgaagagaactacaaagaattaattaaatgggttgatgccaaaactacaaaatatggcactctgaccgtgttacgtgagaggcgctgcggaagatgtggcacagcattgaaggttataaatgacatgattcaagaggactctgagcaaccaaagaaaaaactttacgatttgaagctccagctgattgaggagataggatgggcacacgtatcagcttatgaaaggcagtggatgcat

SEQ ID NO: 140 - DNA, 4672 bp, Zea mays
aggcacaaaatatctgttggactagtggctagccccgccccggctagacgccacgatccattagccctagccaacgaccggctgccagactgcaacagccaccggcggtcggcacgacagcacggtccttccattgttgctcccagctccaacgcagcattactcatctccattctccagtccgataatccactcattacctcatcatcgtttccaaaagcaaagctttccacgcagattccaccattaaattgggcgaacttttttgaattaaaaactcaaatcctggaaaacgagatgcggtaggctggtagtaggaggactaatcatgtgggcgacgctacataaacccgtcgcgcacgccaacttgcgtctcctcctcacagtctccgccttctccggaccactccacttaggcaccgccagcgctgtcgcggcggcggttacgacccgacgctcgagttctagcaggggcgtcgcggccaccgcgatgccttcgtcgtctccgcctccgctgccaccagccgaggagacgaccgcctctgctgccgctctcgcccctgagggtggattctccctcaccgagccctcgttcctcgagtccctcatgccgaagaaggagatcggcgtcgaccgcttcctcgccgctcaccctgagtatgacgggcgcagcgcactcatcgctatcttcgattctggagtcgatccagctgctgctgggttacagactacttcagatggaaagcctaaaatccttgatgtacttgattgcactggtagtggtgatgttgacacgtccaaagtggtgaaagctgatgctgatggtgctattgttggtgcttcaggtgcccgtttggttataaacccctcatggaaaaacccttctcaagagtggcatgttggctgtaaattaatatatgaactgtttactgacacacttacatctcgattgaagaaagaaagaaagaagaaatgggacgaggaaaaccaggaatcaatttccgatgctctgaagcagctgaatgaatttgaaaagaagcatcctaagcctgatgacaccatgctgaagaaggcacatgaagacatgcaaagcagacttgattacctgaggaaacaagctgaaggttatgacgataaggggcctgtaattgacattgttacatggaatgatggtgatgtgtggagggttgctgtcgatacccagacccttgagggtaacaatgatggtggaaaactagcagattttgttcctctgacaaactacaggcttgaacgcaaatatgcaattttcagcaaattggatgcttgctcttttgtagcaaatgtttataatgatgggaaccttgtcagtatagtaactgactgctctccccatgctactcatgtcgcgggcattgcagctgcatttcatccagatgaacctctgctgaatggagttgcacctggagcacaattgatttcctgtaagattggagacactcgcttaggatctatggagacagggacggggctggtgagggccttgatagctgcagtagagcacaaatgtgatctgattaacatgagctatggagagcctacccttcttcctgactatggcagattcattgatctttctaatgaggttgtggacaaacatcgcattatatttattagtagcgccggaaacaatggaccggctttgaacactgtgggtgctccaggtgggactagtacaagcattattggtgttggtgcttatgtttcaccagccatggctgctggagctcactgtgttgtacaaccacctgcaaagggaatggagtacacatggtctagccgcgggcctactgctgatggggatcttggcgtttccattagtgcacctggtggtgcagttgctcctgtaccaacttggacgcttcaatctcgcatgctcatgaatggcacttccatgtcatctccttctgcctgtggtggggtagctcttcttgttagtggcatgaaggctgaaggcattccattaagcccttattctgtaagaaaagcaatagagaatacagccgcatctataagtaatgcacctgaggagaaactgaccacaggaaatgggcttttgcaagttgatagggcttttgaatatgcacagcaggctaagaagttgccacttgtttcttatagaatctcaatcaatcaagtgggaaagtcagttccaaaactaagaggaatatacctccgcgggggcaatgcatgctgccaaacaagtgagtggactgtgcaacttgacccaaaatttcatgagggcgcgagtaacttggagcaactggttccttttgaggagtgcctgcaactgcattctactgatacctctgtggttcaaattcctgagtatatactggtgacaaacaatggacgcagtttcaacattgttgtcaatcctgctaatatcagcagtggccttcactattttgaagtttatggcatagattacaaagcaccatggcgtgggcctattttccgtgtgccaattactgtaataaagcctattgctctattgggagagccaccactattgtcaatttcaaaccttcgttttcaatctggtcatattgaaaggaggttcataaatgtaccttttggagcttcatgggcggaagttactatgcgaacatcagcttttgatactcctagaagattctttttggacactgttcagatctgtccactgaagcgacctgttaaatgggaggctgttgttactttctcttctccatcttcaaagaatttcagttttcctgtagaaggtggcttaactttggagttgtccatagcccagttctggtctagtggaattgctagccatgaacctacctgtgttgattttgagattgtgctgcatggaatatccattgatcagaaagtaagtacccttgatggtgagtcacccttgcttatagttgctagatcacttctagcgtcagagaagcttgttcctgttggcaccctgaacaagatcaggataccttatcgacccgtggagtgtaatctttcttcacttcccactgaccgtgataaattgccctctggcaagcaaattattgccctgaccttaacttacaagttcaaattagaagacaatgctgaaataaagccccatgtgccactgcttaacaacagaatatatgacaataaatttgagtctcagttttatagaatatcagattcaaacaagcgtatttactcgtccggagacgtttaccctagttatgtcagactttccaaaggagaatacacgttgcaactgtacataaggcatgagaatgtgcaattcttagagaaactcaaggaactggttctgtttattgagaggaaactagacaaaaaggatttcgttccattgatgttctactcccaacctgatggtcctatagttggaagtggcaccttcaaatccactgttctagttccaggcgaacctgaagcattctatgtgggtcctccgtctagtgaaaaactcccaaagaatgctccacctggggctgttttggttgggtccataacctatggtactgtaagcacatttaacaagaaagatgaacaaaaccaccgtgctccagtatcttatagtatctcatataccattttgccatcaaaggttgatgataaagaaaagggggttttagttggtacaaagagcatacctgaacagttagatgaggaggttcgagacaccaagataaagtttctttccagcgttaagcaactaactgaggaggacaagtctgcctggtcagaacttgtggtttctctgaagtcagaatatccgaagtacacacctttgctttctaagattttgcaatgtgtcctccagaaaggaactgatggtgataagattagccatgaaaaagaggttattgctgcagccgatgaggttgtgggcagtattgataaagaggaactggctaagtatttatctctaaattcagatcctgaagatgaagaagcacagaaattcaagaaaaaaatagaagaaacgcgagatcagttggctgatgcactatatcaaaagtgtcttgcattggctgagattgaatcactgaagtctgatgagtcaattgaggtatctgctaaagatatttttgaggagaattacaaagaattgattaaatgggttgatgtcaaatctgcaaaatatggcacttcgactgttttgcgtgaaaaacgctgtggaagacctggtacagcattgaagattctaaatgatttgattcaaaatgaatctgaaccaaagaaaaagctttatgatttgaagatccagttgattgaggagatgggatggaaccatgtctcaacctacgaaaaacagtggatgcaagtccgctttcccccatgtctgccaccattttgattgtgaactcatttttacaatggctctatcatcctgggttcagtagttgtcattttcattgctgggtgcgtcagttcattatttcgatggcaaacagccaactaggcaagctactggatttgtgcgtttggggacacagttattccatagttattttgtggtacaatatcaggggagtcctttctccaaggagataagacggaacagagatattttgatggacttgaaggagattttatcctcttcaatccttataatgtctatcaaaccaaataaggtttataa

SEQ ID NO: 141 - DNA, 4872 bp, Setaria italica
atggatccagtttgcctttccccgtacctccgcgatttttcctgctattttgctaggatagcacccagattatctgttcggcacctggctagcggctagcccgcctacccgccacgctccatcagccccagccaaccaccggccgccagccagacttcaaaagccaccgggcggccggcacggtctctccattgttgctccacagctccaaatctccaatgcagcattactcgtatctccactccaatttcccactcatcacctcatcatcgttttcagaagctaagctttccacgcagattccacgattataaagtcgacgaactttcaaattaaaaactcaaatcccggaaacgtgaggtggcaggaccgaatcatgtggccgtcgctacataaacccgtcgcccacgcccacctgcgcctcctcctcgcagtctccgcctgctccggtccactccacttcggcaccaccaccagcgcagtcgcggcggcggttacgactcgaggcccgagcccgagcagcggcgtcgcggccaccgcgatgccttcgtcgtcctcctcgccgccgccgccagccgaggagacgaccgccgccgcctcccccgcgggtgggttccgcctcaccgagccctccttcctcgagtcgctgatgccgaagaaggagatcggcgtcgaccgcttcctcgccgcgcaccccgagtacgatgggcgcggcgcgctcatcgccatcttcgattctggagttgatccagctgctgctgggttgcagactacttcagatggaaaacctaaaatccttgatgttattgattgcaccggtagtggtgatgttgacacatccaaagtggtgaaagctgatgctgatggtgctattgttggtgcttcaggtgctcgtttggttgtaaactcctcgtggaagaacccttctcaagagtggcatgttggctgtaaattgatatatgaactgtttacttatacacttacatctcgattgaagaaagaaagaaagaagaaatgggatgaggaaaaccaggaagcaatttctgatgctctgaagcagctgaatgaatttgaaaagaaacacactaagcctgatgatgccacgctgaagaaggctcatgaagacttgcaaagcagacttgattacctgaggaaacaagctgaaggttatgatgacaagggacctgtgattgatattgttgcatggcatgatggtgatgtttggagggttgctgttgatacccaaacccttgagggtaaaaataatggcggaaaactagcagactttgttccgttgacaaactacaggcttgaacgaaaatatgcaatttttagcaaattagatgcttgctcttttgtagcaaacatttacgatgatgggaacctcgttagtatagtaactgactgctctccgcatgctactcatgtcgcgggcattgctgctgcatttcatccagatgaacctttgctgaatggagttgcacctggagcacaattgatttcgtgtaagattggagacacccgcttaggatcaatggagacagggacaggcctggttagggccttgatagctgcagtagagcacaaatgtgatttgattaatatgagctatggagagcctacaattcttcctgactatggcagattcattgatctttctaatgaggttgtggacaagcatcgtattatattcattagtagtgctggaaacagtggacctgctttaaacactgttggtgctcctggtgggactagtacaaccataattggtgttggtgcttatgtttcaccagctatggctgctggagctcactgtgttgtacaaccaccagctgaggggatggaatacacctggtctagccgaggccctactgctgatggggatcttggtgtctccattagtgcacctggtggggcagttgctcctgtaccaacttggacgcttcaatctcgcatgcttatgaatggcacttccatggcatctccttctgcctgtggtggggtagctcttcttgttagcggcatgaaggccgaaggcattccattaagcccttattctgtaaggaaagcaattgagaatacagctgcatgtataagtaatgcacctgaggagaaactgactacaggaaatgggcttttgcaagttgatagggcttttgaatatacacagcacgcaaagaagttgccacttgtttcttatagaatctcaatcactcaagttggaaagtcaattcctaaattaagaggaatataccttcgggggagtaatgcatgtcaccaaacaagtgagtggactgttcaacttgaccctaaatttcatgaggatgccagtaatctggagcaattggttccttttgaggagtgcctgcagctgcattcaactgatacctctgttattcaaattcctgaatatatattggtgacaaacaatgggcgcagtttcaacattgttgtcaatcctgctaatatcagcaatggccttcactattatgaagtttatggcatagattacaaagcaccgtggcgtggacccattttccgcgtgccaattactgtaataaagcctattactctactgggagagccaccattattgtcaattacaaacctttcgtttagatctggtcatattgaaaggaggttcataaatgtgccttttggagcttcatgggcagaagttaccatgcggacatcagcttttgatactcctagaaagttctttttggacactgttcagatctgtccactgaagcgacctatcaaatgggaggctgctgttagtttctcttcaccttcttcaaaaaatttcagttttcctgtagaaggtggcttaactttggaattgtcaatagcccagttctggtctagcggaattgctagccacgaacctacttgtgttgattttgagattgtgttccatggaatatgcattgatcagaaagtaattgcccttgatggcagtgagtcacccttgcgtatagttgctagatcacttctagcatcagagaagcttgctcctgttgccacccttaacaagatcaagacgccttatcgacctgtggagtgtaatctttcttcacttcccactgaccgtgatagattaccctctggcaagcaagttattgcactgaccttaacttacaagttcaaactagaggacagtgctgaagtaaagccccacgtgccactacttaacaacagaatatatgacaacaagtttgagtctcagttttatagaatatcagattcaaacaagcgtgtttactcttctggcgatgtctaccctagttatgtcaaactttcaaaaggagaatacacactgcaactgtacataaggcatgagaatgtgcaattcttggagaaactcaagcaattggttctgtttattgagaggaaactagataaaaaggatttcattccattgagtttttactctgaacctgatggccctatagttggaagtggcaccttcagatccacaattttagttccaggagaacctgaagcattctatgtgagtcctccatctagagaacaactcccaaagaatgctccacctggggctgttttggttgggtccataacctatggtactgtaagcacatttaacaagaaagatgaccaaaaacagcatgctccagtatcttacaatatctcgtatagcattccaccatcaaaggttaatgatgataaagaaaagggggtttcagttggaacaaagagcatatctgagcagttagttgaggaggttcgggacaccaagataaagtttctttccagccttaagcaagaaactgaggaggacaagtctgcctggtcggagcttgttgcatctctgaagtcagaatatccaaaatatacacccttgcttgctaagattttggaatgtgtactccggaaagcaaatgacgataagattggccatgaaaaagaggttattactgcagctgatgaggttgtggacagtatcgataaagaggaacttgcaaagtatttatatctaaattcggaccctgaagacgaagaagcccagaaatttaagaaaaaactggaagaaacacgggatcagttcgctgatgcactataccagaagggtcttgcattggcagagattgagtcactaaagtctgatgaatctatcgaggcatcttctaaagatatttttgaggaaaattacaaagaattgattaaatgggttgatgctaaatctgctaaatatggcactctgactgtcttgcgtgagagacgctgtggaaggcctggtacagcattgaaggttctaaatgacctgattcaaaatgaatctgaaccgaagaaaaagctctatgatttgaagatccagttgatcgaggaaatgggatggagccatgtttcaacctacgaaaagcagtggatgcaagtccgctttcccccaactctgcctccgttttgattatcaacccatatctttactatcattctctagaatcagttcaattgttgccattgttacatcagttgattgtttcgatggtcatttacttggcattttctcttaaatagtaataatataaagggcatataggcaagctacatgatttttgtgttattttctttttttgtttgtttagcatctttcgagcaatcctgactttaagaccgaggtggtcgattacatatttagggtcaaaccgtcaaacgacgtttggacggcggcggcatcaatagttttgcgcacggagcatctgtgcaatgggcactgacgtagccatggccgttgtcgtgccaaaacatttccggtttcctgttaggggtgcattgattgcgtccccggagttggtctcgaaatataagcagagtgagttggggcccgtttggatggctaagcgagcc

SEQ ID NO: 142 - DNA, 5173 bp, Sorghum bicolor
cctgcctactcgccggagcaaaggcaaacatcagaagagatattgctaaagagcaacgaaattaatttggcaagggcaattattttgtaatggtttcatgtttgtcgtttgaagtgggaattttctaaattgctatggttccaaagtgggcattcagtttgtctttctcatacctcctccacatcttattttccaagttgctaggataggcacaaattatctgttgggctagtggccacgccacgctccattagccccagccaaccaccggcgctcggcacgacggcacggtctctccattgttgctcccagctccaatgcagcattactcgtctccattctctcttccaattttccacttatttatctcatcatcgtttccaagagcaaagctttccacgcagattccacgattaaattaggccaactttttttgaattaaaaactcaaatcctgtaaaacgggatgtggtagcctggcaggagccggactaatcatgtgggcgtcgttacataaacccgtcgcccacgccaacctgcatctcctcatcgcagtctccgcctgttccggaccacttcacttcggcaccgccagcgctgtcgcggcggcgcttacgacccgacgctcgagtcctagcaggggcgtcgcggccaccgcgatgccttcgtcgtccccgtctccgcctccaccagccgaggagacgaccgcctctgctgccgctccggcccctgcgggcgggttccgcctcaccgagccctcgttcctcgagtccctcatgccgaagaaggagatcggcgtcgaccgcttcctcgccgcgcaccctgagtacgacgggcgcggcgcactcatcgctatcttcgattccggagttgatccagctgctgctgggttgcagactacttcagatggaaagcctaaaatccttgatgtacttgattgcactggtagtggtgatgttgacacgtccaaagtggtgaaagctgatgctgatggtgctattgttggtgcttcaggtgctcgtctggttataaactcctcatggaaaaacccttctcaagagtggcatgttggctgtaaattaatatatgaactgtttactgacacacttatatctcgattgaagaaagaaagaaagaagaaatgggacgaggaaaaccaggaagcaatttctgatgctctgaagcagctgaatgaatttgaaaagaagcatcctaagcctgatgacactgtgctgaagaaggctcatgaagacctgcaaagcagacttgattacctgaggaaacaagctgaaggttatgatgataagggacctgtaatcgatattgttacatggaatgatggtgatgtgtggagggttgctgtcgatacccagacccttgagggtaacaatgatggtggaaaactagcagattttgttccactgacaaactacaggcttgaacgtaaatatgcaatttttagcaaattggatgcttgctcttttgtagcaaatgtttataatgatgggaaccttgttagtatagtaactgactgctctccccatgctactcatgtcgcgggcattgcagctgcatttcatccagatgaacctctgctgaatggagttgcgcctggagcacaattgatttcctgtaagattggagacactcgcttaggatctatggagacagggacaggcctggtgagggccttgatagctgcagtagagcacaaatgtgatctgattaacatgagctatggagagcctacccttcttcctgactatggcagattcattgatctttctaatgaggttgtggacaagcatcgtattatattcattagtagcgccggaaacaatggaccggctttaaacactgttggtgctccaggtgggactagtacaagcattattggtgttggtgcttatgtttcaccagctatggctgctggagctcactgtgttgtacaaccacctgcaaagggaatggagtacacatggtctagccgaggccctactgctgatggtgatcttggcgtctccattagtgcacctggtggtgcagttgctcctgtaccaacttggacgcttcaatctcgcatgctaatgaatggcacttccatggcatctccttctgcctgtggtggggtagctcttcttgttagtggcatgaaggctgaaggcattccattaagcccttattctgtgagaaaagcaatagagaatacagctgcatctataagtaatgcacctgaggagaaactgaccacaggaaatgggcttttgcaagttgatagggcttttgaatatgcacagcaggctaagaagttgccacttgtttcttatagaatctcaatcaatcaagtgggaaagtcaattccaaaactaagaggaatatacctccgcgggggcaatgcatgccgccaaacaagtgagtggactgtgcaacttgacccaaaatttcatgagggtgcaagtaacttggagcaactggttccttttgaggagtgcctgcaactgcattccactgatacctctgtggttcaaattcctgagtatatactggtgacaaacaatgggcgcagtttcaacattgttgtcaatcctgctaatatcagcagtggccttcactattttgaagtttatggcatagattacaaagcaccatggcgtggacctattttccgtgtgccaattactgtaataaagcctattactctattgggagagccaccactattgtcaatttcaaacctttcttttcagtctggtcatattgaaaggaggttcataaatgtaccttttggagcttcatgggcggaagttactatgcgaacatcagcttttgatactcctagaaggttctttttggatactgttcagatctgtccactgaagcggcctgttaaatgggaggctgttgttactttctcttctccatcttcaaagaatttcagttttcctgtagaaggtggcttaactttggagttgtccatagcccagttctggtctagcggaattgctagccatgagcctacctgtgttgattttgagattgtgttccatggaatatccattgatcagaaagtaactacccttgatggcgagtcacccttgcttatagttgctagatcacttctagcatcagagaagcttgttcctgttgccaccctgaacaagatcaggatgccttatcgacctgtggagtgtaatctttcttcgctgcccactgaccgtgatagattgccctctggcaagcaaattattgccctgaccttaacttacaagttcaaactagaagacagcgctgaaataaagccccatgtgccactgcttaacaacagaatatatgacaacaaatttgagtctcagttttatagaatatcagattcaaacaagcgtatttactctactggagacgtttaccctagttacgtcaaactttcaaaaggcgaatacacgctgcaactgtacataaggcatgagaatgtgcaagtcttggagaaactcaaggaattggttctgtttattgagaggaaactagataaaaaggatttcgttccattgagtttctactctgaacctgatggtcctatagttggaagtggcaccttcaaatccactgttttagttccaggcgaacctgaatcattctatgtgggtcctccatcgagagaaaaactcccaaagaatgcttcacctggggctgttttggttgggtcgataacctatggtactgtaagcacatttaacaagaaaggtgaacaaaaccaccatgctccagtatcttatagtatctcatataccattctgccatcaaaggttgatgatgataaagaaaagggggtttcagttggtacaaagagcgtatctgagcagttaaatgaggaggttcgagacaccaagataaagtttctttccagtgttaagcaacaaactgaggaggacaagtctgcctggtcggagcttgtggcttctctgaagtcagaatatccaaagtacacacctctgctttctaagattttggaatgtgttctccagaaaggaactgatgatgataagattagccatgaaaaagaggttattgctgcagccgatgaggttgtgggcagtattgataaagaggaactggccaagtatttatctctaaattcagatcccgaagatgaagaagcacagaaattcaagaaaaaaatggaagaaacacgggatcagttggttgatgcactatatcaaaaatgccttgcattggcagagatagagtcactgaagtctgatgagtcaattgagacatctgctaaagacatttttgaggagaattacaaagaattgatcaaatgggttgatgccaaatctgcaaaatatggcactctgactgttttgcgtgaaaaacgctgtggaagacctggtacagcattgaaggttctaaatgatttgattcagaatgaatctgaaccaaagaaaaagctttacgatttgaagatccagttgattgaggagatgggatggacccatgtctcaacctacgaaaagcagtggatgcaagtccgctttcccccaagtctgccaccgttttgatcgtgaactcatatgtttacaaccattctatcatcctgggttcagtagtggtcattttcattgttgggtgcgtcagttcattatttcgatggtcatttgcttacacttcagttttctcgtataaataataatataaaaaagtcaactaggcaagctactggatttgtgcgttattttttttttcttttgtcatctttcgatcgcaattgactcatttatgtttgtgagagagcatacattatattatgggacgagtaaaaaatgattacgccttatacactgcgagggagtataattttgttagaaaaggaagagactgcgcatggggcatgtgtgcaatgggaactgacgtaatggcgccatgtaaggtcagtggtggcaggaatcttcgatttcaaggttagccgtcacacagttgtttcaaagttaaccagtggtacaatagcaggggtgggttggctcaccatcccgcattaaacagagttagtcattaagcagaataaccgcacaaaagcatcacaaagcatcacttgtttaaggcactttgaggacgcgataggcataactgatgagggcagtcccaatgggtagtttcttgatgcattatccaagaga

SEQ ID NO: 143 - DNA, 3865 bp, Avena sativa
cgcctcctgttcctcctcctcctccagccccgcaccgctccacaccggccccaccgtcgcggctcgaggcccgagccctagccccggcgtcgccgccaccgcgatgccgtcttcgaactccgcgcccacgacgcccgccgacgagacgaccgccgccgccaccagcgggttccgcctcaccgagccctcgttcctcgagtcgctgatgccgaagaaggagaccggcgtcgaccgcttcctcgccgcgcaccccgagtacgacggccgcggcgcgctcatcgcaatcttcgattctggagttgacccggctgcggctggcttgcagacgacttctgacgggaaacccaagatccttgatgttattgattgcacgggtagcggtgatgttgacacgtccaatgtggtgaaagctgatgccgatggtgctataattggtgcttcaggaactcgtctgattgtgaactcttcatggaagaacccttctcaagagtggcgtgttggctacaaattagtatatgaactctttacggacacatttatctctcgattgaagaaggaaagaaaaaagaaatgggatgaagaaaaccaagaagcaatatccggagctctgaaccagctgaatgaatttgaaaagaaacatggtaagcctgatgatgccaaactgaaaaaggctaaagaggacctgcaagatagacttgattgtctgaagaaacagtcagatggttatgatgacaagggacctgtgattgatgttgttgtatggcatgatggtgatgcgtggagggttgcagttgatactcaggggcttgagggtaacaaagattgtgggaaactagcagattttgttcccttgacaaactacaggcttgagcggaagtttgggatttttagcaaattagatgcttgctcttttgtagcaaatgtctatgatgatggaaaccttgtcagcatagtaactgattgctctccgcatgctacccatgttgcaggcattgcagctgcttttcatcctgaagaacctttgcttaatggagttgcacctggagcacaattgatttcttgtagaattggagatacccgcttaggatcaatggagacggggaccggcctagttagggccttgatagctgcagtagagcacaaatgcgatctgattaatatgagctatggcgagcctactcttcttcctgactatggaagattcatcgatctcgttaatgaggttgtagacaagcatcgtattatatttattagcagtgctggaaacaacggtcctgctttaaacactgttggtgctcctggtgggactagttcaagcattattggtattggtgcttatgtctcaccagctatggctgctggagctcactgtgtcgtgcaacctccatcagaggggatggaatatacatggtctagtcgaggtccgacagctgatggggatcttggtgtctccattagtgcgcctggtggagcagtggcccctgtaccaacatggacacttcagtctcgcatgctcatgaacggtacttccatgtcatctccttctgcctgtggaggtgttgctcttcttgttagtgccatgaaggccgaaggcattccattaagcccttatactgtgaggaaggcaattgaaaacacagctgcatctataagtgatgtgcctgaggagaaactgactacaggacatgggcttttgcaagttgatagggcttttgaatatgcgcggcaagctaagaagttgccacttgtttcttacagaatctcaatcaatcaagtagggaagtcaattccaaaactaagagggatatatcttcgtgggagtaatgcatgtcaacaaacgagtgagtggactgttcaactgaacccaaaatttcacgaggatgccagcaatttggagcaattggttccatttgaggagtgcctgcagctgcattccactgatagctctgttgtcagtattcccgagtatatattgttgacaaacaatgggcgcagtttcaacattgttgtcaatcccgttaatattagtagtggccttcactactatgaagtttatggcatggattgcagagcaccatggcgtgggcccattttccgagtgccaattactgtaataaagcccattgctttatcaggagagccaccagtattgtcactttccaaactttactttaagtcaggtcatattgaaaggaggttcataaatgtgcctattggggcttcgtgggcggaagttaccatgcgcacatcagcatttgatactcctagaaggttctttttggatactgttcagatgtgtccactgaagcgacctattaagtgggaggctgttgttactttctcttcaccatctctcaagaatttcagtttttctgttgaaggtggcttgactttggagttgtctatagccctagttttggtctagtggaaatgctagccatgaacctacatgtgttgatttcgagattgtgtttcatggaatttctgttgatcagaaagtaattgcccttgatggtagtgagtcacctatgcggattgttgctagatcattattagcatcagaaaggcttgttcctgtcgccagcctgaacaagatcaggatgccttatcgaccagtggagtgtaacttttgtccacttcccactagccgtgatagactaccctctggcaagcaaattattgcactgactttaacttacaaaatcaaactagaggaaggtgctgaaataaagccccatctgcccttacttaacaacagaatatatgataataagttcgagtctcagttctatagaatttcagattcaaataagtctgtttactcttctggcgatgtctatcctagttatgtcaaacttccaaaaggtgactacacactgcaattgtacataaggcatgaaaatgttcaattcttggagaagcttaagcaattggttctatttattgagaggaaactcgagaagaaggatttcattcaattaagtttctactctgaacctgatggtcctatagttggaaatgccacctttaagtcctctattttagtacctggagaacccgaagcattctatgtgggtccaccatctacagaaaaacttccaaagagttctccacctggttctgttttagtgggctccataacctatggtgtagtaagctcgttcaacaagaaagaagaacaaagccagcatgctccaacttcttatagtattttatgtgtcattccaccatcaaaggtcgatgataataaagaaaagggggtttcagttggaacgaagaagagtgtttctgagcggttaaatgacgaggttcgagacaccaagataaagtttctttccagccttaagaaagaaaaggaagacaacaagtctgcctggactgagcttgtcgcttctctcaagtccgagtatccaaaatatacacctttgtttgccaagattttggaatgtgtacttcaggaatcaacctctgatgataaaattagccatcacaaagaggttattgttgcagctgatgaggttgtggacagtattgacaaagaggaactggcaaagcttctgtctttaaaacctgatcctgaggacgaagaatcacagaaaactaagaaaaagatggaagaaacgcgagaccagctagcggatgcactataccaaaaaggtcttgcattggcagagattgagtcgctaaagcctgatgagtcaacggaagcatctgccaaagatgtttttgaagagaactacaaagaattaattaaatgggttgatgccaaaactacaaaatatggcactctgaccgtgttacgtgagaggcgctgcggaagatgtggcacggcactaaaggttataaatgacatgattcaagagga

SEQ ID NO: 144 - DNA, 4341 bp, Zea mays
cggcacgacagcacggtccttccattgttgctcccagctccaacgcagcattactcatctccattctccagtccgataatccactcattacctcatcatcgtttccaaaagcaaagctttccacgcagattccaccattaaattgggcgaacttttttgaattaaaaactcaaatcctggaaaacgagatgcggtaggctggtagtaggaggactaatcatgtgggcgacgctacataaacccgtcgcgcacgccaacttgcgtctcctcctcacagtctccgccttctccggaccactccacttaggcaccgccagcgctgtcgcggcggcggttacgacccgacgctcgagttctagcaggggcgtcgcggccaccgcgatgccttcgtcgtctccgcctccgctgccaccagccgaggagacgaccgcctctgctgccgctctcgcccctgagggtggattctccctcaccgagccctcgttcctcgagtccctcatgccgaagaaggagatcggcgtcgaccgcttcctcgccgctcaccctgagtatgacgggcgcagcgcactcatcgctatcttcgattctggagtcgatccagctgctgctgggttacagactacttcagatggaaagcctaaaatccttgatgtacttgattgcactggtagtggtgatgttgacacgtccaaagtggtgaaagctgatgctgatggtgctattgttggtgcttcaggtgcccgtttggttataaacccctcatggaaaaacccttctcaagagtggcatgttggctgtaaattaatatatgaactgtttactgacacacttacatctcgattgaagaaagaaagaaagaagaaatgggacgaggaaaaccaggaatcaatttccgatgctctgaagcagctgaatgaatttgaaaagaagcatcctaagcctgatgacaccatgctgaagaaggcacatgaagacatgcaaagcagacttgattacctgaggaaacaagctgaaggttatgacgataaggggcctgtaattgacattgttacatggaatgatggtgatgtgtggagggttgctgtcgatacccagacccttgagggtaacaatgatggtggaaaactagcagattttgttcctctgacaaactacaggcttgaacgcaaatatgcaattttcagcaaattggatgcttgctcttttgtagcaaatgtttataatgatgggaaccttgtcagtatagtaactgactgctctccccatgctactcatgtcgcgggcattgcagctgcatttcatccagatgaacctctgctgaatggagttgcacctggagcacaattgatttcctgtaagattggagacactcgcttaggatctatggagacagggacggggctggtgagggccttgatagctgcagtagagcacaaatgtgatctgattaacatgagctatggagagcctacccttcttcctgactatggcagattcattgatctttctaatgaggttgtggacaaacatcgcattatatttattagtagcgccggaaacaatggaccggctttgaacactgtgggtgctccaggtgggactagtacaagcattattggtgttggtgcttatgtttcaccagccatggctgctggagctcactgtgttgtacaaccacctgcaaagggaatggagtacacatggtctagccgcgggcctactgctgatggggatcttggcgtttccattagtgcacctggtggtgcagttgctcctgtaccaacttggacgcttcaatctcgcatgctcatgaatggcacttccatgtcatctccttctgcctgtggtggggtagctcttcttgttagtggcatgaaggctgaaggcattccattaagcccttattctgtaagaaaagcaatagagaatacagccgcatctataagtaatgcacctgaggagaaactgaccacaggaaatgggcttttgcaagttgatagggcttttgaatatgcacagcaggctaagaagttgccacttgtttcttatagaatctcaatcaatcaagtgggaaagtcagttccaaaactaagaggaatatacctccgcgggggcaatgcatgctgccaaacaagtgagtggactgtgcaacttgacccaaaatttcatgagggcgcgagtaacttggagcaactggttccttttgaggagtgcctgcaactgcattctactgatacctctgtggttcaaattcctgagtatatactggtgacaaacaatggacgcagtttcaacattgttgtcaatcctgctaatatcagcagtggccttcactattttgaagtttatggcatagattacaaagcaccatggcgtgggcctattttccgtgtgccaattactgtaataaagcctattgctctattgggagagccaccactattgtcaatttcaaaccttcgttttcaatctggtcatattgaaaggaggttcataaatgtaccttttggagcttcatgggcggaagttactatgcgaacatcagcttttgatactcctagaagattctttttggacactgttcagatctgtccactgaagcgacctgttaaatgggaggctgttgttactttctcttctccatcttcaaagaatttcagttttcctgtagaaggtggcttaactttggagttgtccatagcccagttctggtctagtggaattgctagccatgaacctacctgtgttgattttgagattgtgctgcatggaatatccattgatcagaaagtaagtacccttgatggtgagtcacccttgcttatagttgctagatcacttctagcgtcagagaagcttgttcctgttggcaccctgaacaagatcaggataccttatcgacccgtggagtgtaatctttcttcacttcccactgaccgtgataaattgccctctggcaagcaaattattgccctgaccttaacttacaagttcaaattagaagacaatgctgaaataaagccccatgtgccactgcttaacaacagaatatatgacaataaatttgagtctcagttttatagaatatcagattcaaacaagcgtatttactcgtccggagacgtttaccctagttatgtcagactttccaaaggagaatacacgttgcaactgtacataaggcatgagaatgtgcaattcttagagaaactcaaggaactggttctgtttattgagaggaaactagacaaaaaggatttcgttccattgatgttctactcccaacctgatggtcctatagttggaagtggcaccttcaaatccactgttctagttccaggcgaacctgaagcattctatgtgggtcctccgtctagtgaaaaactcccaaagaatgctccacctggggctgttttggttgggtccataacctatggtactgtaagcacatttaacaagaaagatgaacaaaaccaccgtgctccagtatcttatagtatctcatataccattttgccatcaaaggttgatgataaagaaaagggggttttagttggtacaaagagcatacctgaacagttagatgaggaggttcgagacaccaagataaagtttctttccagcgttaagcaactaactgaggaggacaagtctgcctggtcagaacttgtggtttctctgaagtcagaatatccgaagtacacacctttgctttctaagattttgcaatgtgtcctccagaaaggaactgatggtgataagattagccatgaaaaagaggttattgctgcagccgatgaggttgtgggcagtattgataaagaggaactggctaagtatttatctctaaattcagatcctgaagatgaagaagcacagaaattcaagaaaaaaatagaagaaacgcgagatcagttggctgatgcactatatcaaaagtgtcttgcattggctgagattgaatcactgaagtctgatgagtcaattgaggtatctgctaaagatatttttgaggagaattacaaagaattgattaaatgggttgatgtcaaatctgcaaaatatggcacttcgactgttttgcgtgaaaaacgctgtggaagacctggtacagcattgaaggtgtggctactggagactctcctcaattggtgatattttcttttggagcatgactgggcatgggtgggcacggcattgtggcgacatcagaagaacatatgatgctagtcctaatgtagataactgactgcgcagggccagatgtgagcagactaggggaaaacttgacatttgcttggttttatttcatctgggttgaaacttgaaatagttccttga

SEQ ID NO: 145 - DNA, 3293 bp, Musa acuminata
atgaaacaactctctccctctgctcccaataaaacgccagcctcgtcctcacctttccactaccacacctttcttttctcctcccccaagaaacataagaggacgagagagctctcgcctcaacaaaataaagataaatcagtgagacagagagaaggagagacaaggtagctcaaggcagagaagaaaagagaagcaaagttgaagaggagaagtagaaatggtttcttcttcttccttcttcttcctcttcttgttgggttcagttctgttcctctccaatgaggctacatctcttccggagctacccaacctcaccaccctctcttttgaggaaggctacacgcagctctttggagactctaatctaatgctacaccgagatggcagagctgtccatcttgctctcgaccagcgaactggtgctggatttgcgtcacaagatctttatctgcatggattcttcagtgcctccatcaaactaccttcagattatgccgctggagtcgttgtcgccttctatatgtcgaatggagatgtattcgagaagtcacatgatgaactggactttgaattcttggggaacataagggggagggaatggagggttcagacaaatgtttatgggaacgggagcacagcagttggaagggaagagagataccaactttggttcgatcccacagaggactaccaccagtactccatcctgtggagccatgagagaatcatattttacattgacaacattcccatcagggaggtggtgaggacacaagccatgggtggggatttcccctcaaagcccatgtccctgtatgccaccatatgggatggttctacctgggccacctctggcggtcgctacaaggtcaactacaaacttgccccttacgtcgcagattttgctgacctcatcctccatggctgtgctgttgatcctagtgatcacaaaacagcctgccagggatccgatgctgtattgtatgatgccatcactatgtcagctgatcaacgaacggcaatggccaagttccgaaagaagcacatgacctactcttactgtcatgatcgcatacgttacccaacacccccaccagagtgtatgtttgttggtcctgaatcccagaactttctcgcatcaggcgaggcaaagttcaactatcgccatcgccgtggtaggcgttatggccgaagctcaatagatgcaaggacaaagggagagatggccgtggaaacgggaattcggaccggtgtctgtatgggctccaaatgcggtgctttgcttcgagagctggagcaaatatggacagaggttggggagagcaaagaggacaaggatctcatgttggtggaattagagagagagtgcattcgagtgtaccgaaggaaggtcgaagaagccggcagcaacagggctcatctccaccgatcgctagcagaaaaagaagcagaggttactgctcttatgtctgccctcggtgagcagagtctccagctaaagacttggattcttattttgcttcacaaacacaagttgatggagaagaggttaccattgagggagcaacttgcatcagttaaccctcttttggaagatttacgaaaaaagaaagaggaacggctgaaacagtttgctgatataaagtcacagattgagaagatcaatgtagagattttgggatccagtcaccatgatcattctccagttaagattgaagaagatgatttgtcaataagaaaactcaccgagtatcaatcacagctacgcattctccagaaggaaaagtctgatcgccttcagaaagtactggagtctgtaaatgagatgcattctttatgtgaacatcttgaagtggactttaggaagaccgtggatactgtgcaccccagtctgcatgacactggtggaggacattctccaaacataagtgagacagcacttgagggcctatctcaagcaatcctaaagctaaaaactgaaaagaagatacgaactcaaaagttgctagaagcagtggagtcacttttggaactgtggaatctaatggatacacctgttgaggagaggaaatactttggagaagtaacatgcattcttggattacctgaacatgatattggatgttttggtctactctcacttgatacgattaaacagatggaagctgaggttgagagactcacaaaccttaaagctaggagaatgaaagaacttgttttaagaaaaaggatggaactagaagagatatgcagaactgcacacattgaacccgatatgagcacagcatcggagaaaattggcgcacttatagattctggtatcgtagatccttctgagcttctgactaaaattgagatgcaaattgtgaaagccagagaagaatccatgatcaggaaagaaatcatggagagagtagacaaatggcttgcagcatgtgaagaagagaattggcttgaagattatgaccaggatgagaacaagtacagtgctggaagaggtgcccacttgaatctaaagcgtgccgagaaagcacgggcgattgtcaccaaaattccagatactgttgacaaattgatgaacaaaatatctgtgtgggagaaagaaagaaatatgcctttcttgtatgacggggtgccattggtgtctctattggaggaatacaaagttataaggctaaagaaggaagagttaaaaagacgatatcgagaccagaaaaaattacagaatctgttgctcacagggaaggaaacagtttatggatcaaaacctagtccaaaaaggagcaacaattttaaccgaaaaacaaatgacaatggcttcatgatgcccgctccttggaggctttctgccggtggcgcaacacctgatttgctcatgcagtgttcatactctggccattctaatggatgcttcaaggagataagacggttgtccaccacatcattgaacctcatttcaatctctaaagacgatagagtgccttcgttggcatctgttaccagttcggaacctgggtctccacctctgaatcaactctcaggtcttaatcgatagagatgctggagtatattgttatcacatttcgcgtgcgtgcaagtttatgctggtaattagcttggagtttcgcattcagaatctaggataatacttgtaacaatcaatgcatgtacactttttgttctgatttgtattccttagaagatttggtaggtactatgaacaatagacttcaccaatgaaagtacagaaacaatgagaatgtggatacatgaaataacctgcagggcct

SEQ ID NO: 146 - DNA, 1560 bp, Musa acuminata
ctcacctttccactaccacacctttcttttctcctcccccaagaaacataagacgacgagagagctctcgcctcaacaaaataaagataaatcagtgagacagagagaaggagagacaaggtagctcaaggcagagaagaaaagagaagcaaagttgaagaggagaagtagaaatggtttcttcttcttctttcttcttcctcttcttgttgtgttcagttctgttcctctccgatgaggctacatctcttccggagctacccaacctcaccaccctctcttttgaggaaggctacacgcagctctttggagactctaatctattgctacaccgagatggtagagctgtccatcttgctctcgaccagcgaactggtgctggatttgcgtcacaagatctttatctgcatggattcttcagtgcctccatcaaactaccttcagattatgccgctggagtcgttgtcgccttctatatgtcgaatggagatgtattcgagaagtcacatgatgaactggactttgaattcttggggaacataagggggagggaatggagggttcagacaaatgtttatgggaacgggagcacagcagttggaagggaagagagataccaactttggttcgatcccacagaggactaccaccagtactccatcctgtggagccatgagagaatcatattttacattgacaacattcccatcagggaggtggtgaggacacaagccatgggtggggatttcccctcaaagcccatgtccctgtatgccaccatatgggatggttctacctgggccacctctggcggtcgctacaaggtcaactacaaacttgccccttacgtcgcagattttgctgacctcatcctccatggctgtgctgttgatcctagtgatcacaaaacagcctgccagagatccgatgctgtattgtatgatgccatcactatgtcagctgatcaacgaacggcaatggccaagttccgaaagaagcacatgacctactcttactgtcatgatcgcattcgttacccaacacccccaccagagtgtatgtttgttggtcctgaatcccagaactttctcgcatcaggcgacgcaaagttcaactatcgccaccgccgtggtaggcgttatggccgaagctcagtagatgcagttctttgaatctaagtgattgaacattgaataggttcatgtactctcagggtttttttctttttttcctgtgtaccacgcattttggtgttgtatagcaaatttatttggtgtggagtttggggagctttgagtagagctatgttgggtcgattcacatgggttcaatgacatacacatgtactgaggtttaccacatagcccgagtcgatacagtatgagcggtacatatcgatctgacgagcaactgagatgtggattgctcgagtcctcgtcgacacaccctagcatatcgtgtgtcagtacaccagtatgaagcagtacataccatattgccaacaaccttgaaatgtacaactaagtctttcaaagcttgtttcagggtctattttgttca

SEQ ID NO: 147 - DNA, 1269 bp, Musa acuminata
ccttgtccttagctttccactcccatacctttctttactcctctcccaagaaacataacagaaaggagaagagcagagaagcaaactcgaggaagagaaagaagaaatggcttcttcttcttcgttcttcttcgtcctcttcttcttgttggtttcggctctgttccttgagaccactgctcttccggagctacccaacctgaccactctctctttcgaggaaggctacacgcagctcttcggagactccaacctcatgcttcaccgcgatggcatggctgtccacctctccctcgaccagcgaactggcgctggatttgcgtcgcaggacctctatctccatggagtcttcagtgcctccatcaaactgccctcagattacgctgccggagtcgtcgtcgccttctatatgtcgaacggagatgtattcgagaagacgcacgacgaattggactttgagttcttggggaacataagaggccgggagtggagggttcagaccaacgtttacgggaacggcagcacggccgtcggaagggaagagcggtacgggctctggttcgatcccacagaggactaccaccgctactccatcctgtggagcaaccggaggatcatattttacatcgacaacattcccatcagggaggtggtgaggagccaagccatgggtggggacttcccttccaagcccatgtccctctacgccacaatctgggacggctccaactgggccacctccggcggccgctacaaggtcaactacaaattcgccccttacgttgcagaattcgccgaccttgtcctccacggctgcgccgtcgatcccagtgatcgtagaagagcctgccaggcatctgatgctgaactctatgatgccatcacaatgtctgccgatcaaagaacaaccatggagacgttacgcaagaagcacatgacctactcttactgtcatgaccgcattcgttacccagcaccaccaccagagtgtgttcttggtcctgaagccgagtcattccttgcatcaggcgaagcaaagttcaattatcgtcgtcgccggagtaagcattacggccggagctcagtagacgcagtccttctagcctaatggattgaataccgaataagttcacgtagcttagagggattttttttgtgcgtatcatgcaatttgagtggtgtatagcaaatttgtttgaggtattgatgtcaggtgtaatccacattgtttaggtgatatcaaagtgttcttccaatcttttctgtttc

SEQ ID NO: 148 - DNA, 1570 bp, Musa acuminata
cctcacctttccactaccacacctttcttttctcctcccccaagaaacataagacgacgagagagctctcgcctcaacaaaataaagataaatcagtgagacagagagaaggagagacaaggtagctcaaggcagagaagaaaagagaagcaaagttgaagaggagaagtagaaatggtttcttcttcttctttcttcttcctcttcttgttgtgttcagttctgttcctctccgatgaggctacatctcttccggagctacccaacctcaccaccctctcttttgaggaaggctacacgcagctctttggagactctaatctattgctacaccgagatggtagagctgtccatcttgctctcgaccagcgaactgctcttttaggtgctggatttgcgtcacaagatctttatctgcatggattcttcagtgcctccatcaaactaccttcagattatgccgctggagtcgttgtcgccttctatatgtcgaatggagatgtattcgagaagtcacatgatgaactggactttgaattcttggggaacataagggggagggaatggagggttcagacaaatgtttatgggaacgggagcacagcagttggaagggaagagagataccaactttggttcgatcccacagaggactaccaccagtactccatcctgtggagccatgagagaatcatattttacattgacaacattcccatcagggaggtggtgaggacacaagccatgggtggggatttcccctcaaagcccatgtccctgtatgccaccatatgggatggttctacctgggccacctctggcggtcgctacaaggtcaactacaaacttgccccttacgtcgcagattttgctgacctcatcctccatggctgtgctgttgatcctagtgatcacaaaacagcctgccagagatccgatgctgtattgtatgatgccatcactatgtcagctgatcaacgaacggcaatggccaagttccgaaagaagcacatgacctactcttactgtcatgatcgcattcgttacccaacacccccaccagagtgtatgtttgttggtcctgaatcccagaactttctcgcatcaggcgacgcaaagttcaactatcgccaccgccgtggtaggcgttatggccgaagctcagtagatgcagttctttgaatctaagtgattgaacattgaataggttcatgtactctcagggtttttttctttttttcctgtgtaccacgcattttggtgttgtatagcaaatttatttggtgtggagtttggggagctttgagtagagctatgttgggtcgattcacatgggttcaatgacatacacatgtactgaggtttaccacatagcccgagtcgatacagtatgagcggtacatatcgatctgacgagcaactgagatgtggattgctcgagtcctcgtcgacacaccctagcatatcgtgtgtcagtacaccagtatgaagcagtacataccatattgccaacaaccttgaaatgtacaactaagtctttcaaagcttgtttcagggtctattttgttca

SEQ ID NO: 149 - DNA, 1188 bp, Musa acuminata
ctcccaagaaacataatagaaaggagaagagcagagaagcaaacttgaggaagagaaagaagaaatggcttcttcttcttcgttcttcttcgtcctcttcttattgttggtttcggctctgttccttgagaccactgctcttccggagctacccaacctgaccactctctctttcgaggaaggctacacgcagctcttcggagactccaacctcatgcttcaccgcgatggcatggctgtccacctctccctcgaccagcgaactggcgctggatttgcgtcgcaggacctctatctccatggagtcttcagtgcctccatcaaactgccctcagattacgctgccggagtcgtcgtcgccttctatatgtcgaacggagatgtattcgagaagacgcacgacgaattggactttgagttcttggggaacataagaggccgggagtggagggttcagaccaacgtttacgggaacggcagcacggccgtcggaagggaagagcggtacgggctctggttcgatcccacagaggactaccaccgctactccatcctgtggagcaaccggaggatcatattttacatcgacaacattcccatcagggaggtggtgaggagccaagccatgggtggggacttcccttccaagcccatgtccctctacgccacaatctgggacggctccaactgggccacctccggcggccgctacaaggtcaactacaaattcgccccttacgttgcagaattcgcggaccttgtcctccacggctgcgccgtcgatcccagtgatcgtagaagagcctgccaggcatctgatgctgaactctatgatgccatcacaatgtctgccgatcaaagaacaaccatggagacgttccgcaagaagcacatgacctactcttactgtcatgaccgcattcgttacccagcaccaccaccagagtgtgttcttggtcctgaagccgagtcattccttgcatcaggcgaagcaaagttcaattatcgtcgtcgccggagtaagcattacggccggagctcagtagccgcagtccttctagtctaatggattgaataccgaataagttcacgtagcttagagggatttttttgtgcgtatcatgcaatttgagtggtgtatagcaaatttgtttgaggtattgatgtcaggtgtaatccacattgttt

SEQ ID NO: 150 - DNA, 1912 bp, Musa acuminata
acaaactgaaatattacccacttgataaatcaattagttcattacaaaaatccatcgaatctaataaaaagtagattaaaccgatcacttgtctcccaatatgttttgagtttcagtttacaaaatagatagtcatgctctaagacaaagcaaatcatcgttggtacatcataatggatttccatatgatacagaagaaactatcgggcggccaccttaagtatcttgcaacacatccctcgtcaaatttggtacttcttttaactacaatttcttagctaacagagactccattctatgcttcaatagtgatgtgaaacacacatggaagtgccaacgagagcaagacttttgatcatccaagtcttcaatgaaataaccctatctctctctctctctgctcccaatataatggcagcatcggtcctcagctcgctccaactcctacaccttaaccttcctcctgccccaaggtacatgagagagggggagatagagatagaaagagagttattgcctctataataagataaaccactgagacagagagacagccagagaaagagagcaaagccagcttaaggtgaaaaggagaagagcagagcagagacaacaatcttacagaagagatggcttcttcttcttcttcttcttcttcttcttctgctttattcttctactacctcctcctgttgggttcagcactgttcctcaccaatgaggctattgctctcccagaagtgcccaacctcaccaccctctcttttgaggaaggctacacacagctatttggagactccaacctcattcttcatctagatggccggaccgtccacctctccctcgaccagcggactggtgctggatttgcgtcacaaggtctttatctccatggattcttcagtgcctccatcaaactgcctgcagactacgctgctggagtcgttgttgccttctatatgtctaatggagatgtattcgagaagacacatgatgaattggacttcgagttcctggggaacataagaggcagggaatggagggttcaaaccaacgtttatgggaatgggagcacagcagttggtagggaagagagatatgggctctggttcgatcctacagaggattatcaccaatactccatcctgtggagtaatgagaggatcatattttacattgacaacacccccatcagggaggtggtgaggacccaaaccatgggtggtgacttcccttcaaagcccatgtcactctatgccacaatatgggacggctccacctgggccacttcgggcggccgctacaaggtcaactacaaattcgccccttacgtcgccgagttcactgaccttgtcctccatggctgcgtcgttgatcccagtaaccataacagaacctgcctggaatctaatgctggagtttacaatgctatgatgatatcaacggatcaacgggcggcgatggagaggttccgaaagaaacacatgacctactcttactgtcatgatcgcatccgttacctgacaccttctccggagtgttctctcggtcccgagaccaagagtttcctcataacaggcgaagcaaggtccagttaccaccaccaccatggtaagcgcaatggccgcagcacagtagatgtagccctttgagtctaagtagttattttttttgtgtcccatgtattccaagtattctagtgatatagcaaatttatttcaggtagagagtcacattgtctagaatgacatatgtataacctagtctgtccaatcttgttttggagtctgtctagctcatcagtgttttccatattatttccttccctctaatgtttctttttctctgtagtggtgctaatgtactacacaatgggtttgttgtcatagaagacttgagttcgttttgatca

SEQ ID NO: 151 - DNA, 1974 bp, Musa acuminata
acccaaccctgcaaccaaaacacttcatttccttcccttctgactccttccacacctttggcttttcttgctcttcctcttcttccatctaagctcctcctaattccctcttcctgccatggaaagcacaatggaggatacactgaatcttcccatggagtaatggaataagctccatgcaaattttcctactgacctccgagccttgacaagaggatattacttctggctttggccttgcaaccagcctgcaccctgcagctcagagagagagagagagagagagagagagagaggtgggtttgttctgtcctacttctcaagcaatctgcattgctgcatgactccaaccatcatgggggtatgtctaactgttttcatcagttgtacttcgagacaatgaggtggtgacctgaatgctaggaggaaatctctaggcaatgctgttttcctcatagggaggaagtgtgatctcctacaggcaacaagagattcctaaggtgtcttttgtttaaggctcagggctttaccttcctagataaagaggtcagtactggtcttaagattacaatgactacatggtcttgttgcagttccgcagctcttccctgttattgttcttcttcttacagaaaagagaagatctcaaactagtcatttggaacaaatcgtcgagtcctattttaaatgtttgcctaaattaaactgttaatctcactttattctaattttccttttttccttctttgtgtctcctccaatctgtgtttttagaacctggataaggttctttggaacctcaaagcttctatttagactcccaaggattccaaacccaaagcctcagctcacatctcgatccttggggttgggtagctcaaattctgcttctccttcctctactaattttttatttggtttcttttgtccttggaacttttccttctgggattgaggtcaaaaagaacacataaaagaaagaaagagcacaaagattgagagagaatggatctttctggtcatgaaggagagatcccaatcccaataaccagtgcatacgttggtggccatggccaaaccaacatgcgtgacaccccccccatccaccacccctccaatggccctcctcctccgcctcctcccctacccattgccaccacagaggaccaccagcgccaccaccacgctaccaactcccacagcaccaagaaaggggtggcggtgaggtacagggagtgcctcaagaaccatgcagcctccattggtgggaatgccaccgatggctgcggtgagttcatgccgagtggtgaggagggaagtctggaggccttgaagtgctctgcctgcggctgccaccggaacttccacaggaaagagacggaaggagagtcctcatgcgactgcttccaccccctcagggggaggaaggtgatgggtcagaagggcctcctcctctcgggatccgatgcattcggctacggccctgcgtgcaatggcctcattccaagggcaaccccacacagcatgatcatgcctctgggtgccatccagacctccgagtccgacgagatggaaggcgtgggtggaatgatggcgaggcctctcatggtgaagaagaggttccggaccaagttcacccctgagcagaaggagaagatgctgagctttgccgagaaggtgggctggaagctccagaagcaggaggagagtgtggtgcagcagttctgccaggagatcggggtgaagaggagggtcctcaaggtgtggatgcacaacaacaagcaccacttggcaaagaagaaccctctccagcttgaatgaccattacctcactctcatttccatggattgtcttcgtcatttcatgagcttttgtcttcctcggacttcatcaagcttagatgtcaatcctttcagtgttatccatgcattgtgtttacatgaaggcagcagacctcaagttgttatccttcc

SEQ ID NO: 152 - DNA, 2702 bp, Elaeis guineensis
ctctctctctctctctcccccacatctatggcgtaagcttgattcctgatagtgcaagcaaagcaaacaccccacacttttatttttatcacaaccccctaaaactctctctggcctcctcttttgtcctgtaaaaattctcctttttctctttctattttgttccaacctttgtgctctctcactactgctataagcctcttgtttagtgtcccccaaccacaacccttcaaccaaaacaccttcatttcctctctctctctctctcacttcttccatcccatggtgattttctttgtttattcccctgcctcccactcttaagttcttcccataccttcatcttgccagggaattcagtattggagaattcattgcacatcacctccaagtcacaggtggaataccatggtttccttctggtaatctccatactcggttagtttttctctctggagtataagagagagagagtgtgtgtgtgtgtgttgttgggtgggggggaaggtgggtacgttttgtcttaggttcttcaacattctgcatcgttgcatgactccaaccatcacatggagctgttctgcttctgttcttatgttgtactttgagacaatgaaatgagcattggaagaccaagtccttaggcactgttcaagttgttgttgttttcctcatgactggaaaaaaatttaccccccagcacccgcacaagagacttcttaggttaggtgtctttgggtcttagactctggatcttggtaaaccctccaaggaaaaagggaaagaactggtctacaatcaacaaagactttccattctcattccaattccatagtgcctttcttattcttccacttgcatagagttcttgcaagcacaagccagtgctcttcttctatctgtttcccattctgtttgcaaggctcatgtatctatcttcctcttctgttaggtttttaaggttgggaatagtttgaagagtatctagataaggttctctagaatctcagagcttccaattttccagtgtctttctgccaaaacagaagaaaatgggcaagtgggttcattattagtttatttagagtcccaagaacctcagaccttagccacagctgatatttttctcatttgagtggtctaattctctctctgtccttgaccttttccttttggtgtccaggccaaaaaagagcagtaaaaaaaaaagaattagcaaagagagagagagggtgagtaagaaagaatggatctttctggccatgaaggagagatcccaatcccaataaccagcacatatgttggaggccatggtcagaaccatggccacaccatcatccatgatacccctcccctccaccaccaccaccctcccaatggacccccccctcctcctcccttgtccacagccacatcagaggaacaccagcaccaccctgccatcccctacagcaccaagaaaggagtggtggtgaggtacagggagtgcctcaagaaccatgcagcctccattggtggcactgccactgatggctgtggtgagttcatgccaagtggtgaggagggcacactggaggccttgaagtgttctgcctgcaactgccacaggaacttccacaggaaagatgtagaaggggagtcctcctcctgtgactgcttccaccacctcaagggaaggaagatgttgggccagaagggactcctgatctcagggccagaggcatttggctatgctcctgctggcaacagcctcattccaaggccatcaccacaccacatgatcatgcccctgggcgccctgcagacctctgagtctgatgagatggaaggggtcggtggtggggccatggtgaggcctcccatggtgaagaagaggttcaggaccaagttcacaccggagcagaaggagaagatgctgagctttgctgagaaggtggggtggaggctccagaagcaggaggagagtgtggtgcagcagttctgccaggagattggggttaagaggagggtcctcaaggtgtggatgcacaacaacaagcataacttggctaagaagagcccccctctccagcttgaatgaccgctgattccactccctctcttgcttttctctgactttatcatggtttgccgatgcccaatgccgattctagagatggatttagatggtagaatattgttatgactatcttttcttgtgttagtctttcagatttttctctctcgtcagttcgcaattggcaaggtgatgtagctcaaggagtttggtagacatgaaccatgggctcctttttttttttccttctttcagtggctatgaaactttgacattggtcatttcaatatgaatatcgcattgcactttcatggattttctacatctgatgaggaagaagccccttgatgaactgctgtttgttttagtccttctattttccttcaagcgaggttcctctgatccatgagaagataattaaattgcaatttcatttggagcatgggtgccttccgacttctttcttctcataacttgagtttatatggctgtgcctgtctctctttgtatgttagctagaattttggaaatgtcgagtctatccagaatttctcttcaacttagttggttgctttcttgtattgttagcattaatttcttttgtatatgtttttattataatatatgacaagttttcctgcagtca

SEQ ID NO: 153 - DNA, 1838 bp, Musa acuminata
ggctggttctatttcctcctcacattcctggctcttgggatacaaaatcttatcgataggaaccctgctgaagccagacgaagaagagagagatgaggaaggagagcttggccttgttggcgaccctcgtgctgctgctgccaaccgcggaatccaacctcagcagggatgacttccctccgggcttcatctttggagcaggaacttcggcttaccaggtggagggtgctgctgctgaggatggtaggactccaagtatatgggatacgtatactcgtgcagggggaatgctggacaatagcacaggagatgtgacttccgatcaataccacaaatataaggaagacgtgaagctaatggttgatacaggactcgactcctacagattctccatctcttggtcgaggcttctaccgaatggaagaggagccattaatccgaaaggcttggcttactacaacaatctcatcgatgagctactgagatatggaataacgccacatgtgacaatctatcattatgatcttccacaagtacttgaagacgagtacgaaggatggctgagccataaaattgtggaggacttcacagcattcgccgatgtctgcttcagagaattcggcgatagggtgtctcagtggaccaccatcgtcgaacctaacgttatagcgatagggtcattcgacagtgcaatatttccacccagccgatgttctaatcctttcggcttattcaattgcaccgtcggtgactccaccaccgagccatatactgcagctcacaacttcttattggcgcatgcatctgttgtctcattgtacagaacaaagtatcaagccaaacaaaatgggaggataggcttgaatgtgtactccatgtggtgttatccatcgacgaactcaacattagacttgcaagcaacccaaagattattggacttcttcgtcggctggatcataaatcccctggtttttggagactacccaaaggtcatgaagaagattgtccgctcgaggctcccttccttcacggaggagcaatcggagcaactaaagggttcattcgacttcatcggcctgaatcattattcatcgatctgggtcaaggacaactccgatgcctccgagactgcacctcgtgatttcaacgcagatctctttgccaaattcgcaatttcaaagaacgaaacaccaggcagtcagttagtccctactgacatacccttcgatcctgctggcctgcaacatctgttggagtacatcagagacgcttatggaaatcctccggtttatatcgaagaaaatggttatgggcttggattaaacaacacaatctccgacgtcaagagggcgaactacttgagtggttacattggcagcacgctcgatggtattaggaagggagccaatgtgaaaggatactacgtgtggtcatttctagatgtcttcgagttcttgtctgggtttcagtcaccattcggactataccatgtggatttcaaagatgaaaaccgcagaagacaacctaagctctctgcactttggtactccgacttcctcaagaagaagaagaagaagaagactagcacgaatataaacatgatgggactgcaccaaagatctcactctcaacggtgactcatgtgatggttatcctgttgctttggataaagagtgaagtcgcatcatggtttcctacaatgttctctcttcgtcatcgtcttcgtctcatctcctcacatatcttcatttgcttactatatatgctgcttcgtgtcatcctctctattgttacttcttcttatttatttcgttctatcagtgttgaaactttgaata

SEQ ID NO: 154 - DNA, 1433 bp, Zea mays
ctcactccaaagccaacaaacagagctccaactcagaaagcatccgtcccttggcagcagcaacaagctactagctatgtgtgtttacagcgagcgaggggaaaaaaaagaaaacatctaagatatactccatcatcttcgtttgattaacccgcccagtaaagccatgggtactaatgatagagcggtcatttctctagtactcctcgtgtgcatcgctagccgctcgtccttgggtgccgctgaaactgacgttgagcagaagcgctcgtcagtcccgttgatgtttgtgttcggtgattcgctggtcgatgtcggaaacaataacttcctgccgccgcctgcaccccgtgctgcatctccgtacggcatcgacttccctgctggcacccccggcgccgtctcaggacggttcacgaatggctacaaccttgccgatttagtcgcgcgacgtctggggttcaagatgagtccacctgcttacctctcgttgacaccgttatcaaagtttgacctgttcacgtgccgaattggtgccaattacgcgtctggcggatctggcattctcaacaccacgggaaacgggacactcacgctgcagaaacaaatcacgctgttctcgaaaactaaagcaagaatgtcgtggggccgctgcaagctcagctctatggtatcgaggtcgttgttccttatcagcgccggcggcaatgacttctccgccttcagtgaaatgggcatgggcgaacaagacgccccagcctacatcagtagcatggtctcaacctatgtccagcatatcgacgcgttgtacaagttgggagcacggaggttggggatcctagacgtgccagcgatcggctgtaccccaggctccagagtccccatggccaacggcggatgcaacgacgctgccaactctatggcgcagaacttcaacaaactcctaaggctcgaggtggcgaaagccgtcgcatcctccatgcccggcatgagatactccattgcaagcacctacaattttgtcaccgacttgatggacagccatctagtggctgggctccgggtggtcgacagggcatgctgcggatcgggaaaactgaacgccgcggtcatgtgcgcccagccaaacacgacttactgttcggatcgcgacgactacatgttctgggacatgctacatcctacgcaggcaacaaatgaacgtggggtggtcgccatcttctacggcccgcaggagtacgcggatcccatcaactttgcacagttggccgctgccacagcaaatgatgatgatgatataaatactgctatggccgcaggcgtctatgccgccatatgataaaccctatttatgtcgattggcatgcagctgcgacatgtcactacctgagtactatatacgtaattcagttggaacaaaaaaaaaaaaaaaa

SEQ ID NO: 155 - DNA, 2107 bp, Aegilops tauschii
gctcgatcatcatcgtctcctcaaggccatagctagctagctccactatacagaccaccgagggcgcatggcgctgacgagtcacctcctggtcgtcctcctcggcatcgcagtgccgctgctcttcttctcccgtgcagaggggggcgaggtaggcgtgtgctatgggaggatggcgactaacctgcctgacccggcgaccgtggtgcaactgctcaagaagaacagcatcaccatggtgaggatctacgacaccgacccgacggtgctgcgctcgctggccaacaccggcatcaaggtcacggtggagctaaccaacgaggagctgccctccgctgccacggaccaaaatttcgctgatcaatgggtgcagaacaatgtcaaggcgtactaccctgccacactgatcaatggcgtgacgatcgggaacgaggtcttcaaagaggctagtcagttgaactctcagctcgtcccggccatgacgaaggtgcaagcggcgctggctcgcctgggcctggcggacgccgtgaaggtgaccacgcccatcgcgttcgacgcgctcaagatgtcattcccgccgtctgagggcgcgttccgtgacgacatcgcgttgtcggtgatgagccccatggtcaacttcttgcaggaaaccgggtcgtacctcatgatgaatatctacccgtaccttgcgtacctgagtactccgggcatgtccatcgactatctcttgttccgccccaacgttggcgttgttgacaagaatagcaagcaaacgtacttcagcctcctcgacgcgcagcttgacgctgtgtactatgcgatggagaagctgccgtcctccagcctgcgtgctggggggatgaggaagctcacagcagggggcggaatactggaggtgaagcttggtgagagtcaccacccaaccagaggccaccatggcgtgggaacaagagccaacgcccaagcgttcaccgatggtctcatgagcaaagtgcgtggcggtaactccggcaccacctcaaacaaatataaccggctcgccaccagtgctgtcggcaccccgcaccgtcccaacgccgatcttgacgtgtacatcttcgaactcttcaatgaggacaacaagcccgaagacgagcaggacttcgggttgttctacccaaaccagcagcccgtgtaccaagtcgacttcgtccatggtgccggccccgtgcaaccgagctactgcaccgcgaaggccacggccggggacgcggccctgcaggcggcgctggactacgcgtgcggccacggggcggactgcagcgccatccagccaggcaagccctgctacgagcccaacaccaagcttgcgcacgcgtcgtacgccttcaatgactactaccagaagaacggccgggccagcggcgcgtgcgacttcggcggtgccggcaccattgtcaaccaggcaccatcaggccgctgcgaccttagcccgagctggtgtgtcgcgaacgcagcggtgggcgccgcacggctgcagaacgcgctggactacgcctgcggtcatggcgcggactgcactgacatccaacctggagcacggtgcttcgatcccgacaccaaggtcgcccatgcgtccttcgcgttcaatgactattaccagcgccataaccaggccgccggaacgtgcgacttcgccggtgccggtaccattgtccggcaggcaccaaagataggcaactgcgtgctgccgtcaagggcctgaactgaagaaactgtagccaaagcgaagctttactaccacgagattaagcaataatcccgacagattattgtctgctgccggcaaagtctagttttcaaatgtaaaactgcatgcttttcatcaggtgcttagagcaagtacaataatgggcttatagcctggttacgtgtcacttttgcctatgtgaaaaagagtgatgtggaaaaatagtgggagaggactctcatatagagcctagctctatgcttactcctaggcaattgcaataaatatgaagaaagtgatataaagaggtgaaaaaaaaatattcttatagctaaccttattgtatgagtgactatacaataatgctaaacatacaaa

SEQ ID NO: 156 - DNA, 1298 bp, Musa acuminata
cgatcatggagatcgaatgcttgaaggagtttccccaccctctgatggatcgccggccccggaagcgcccgaggttagggtgggacgttgacccccttaccgcggccaaggctcaaataggtatcttatgtggacaagaagttaacttgaagagcttggttccttcggggggtgcttcagatcacacttgtgcatcccagtctgcaaaggatcaggaacgagatgcttcccctccttggagaggagatgataaagatggacattacaagtttgaacttggagaaaatttaacctctcgctataagattcacagcaaaatgggtgaaggtacctttgggcaggttctggaatgttgggatagggaaagggaggaaatggtagccatcaaaattgtccggggcatcaataagtacagagaagctgctatgatagagattaatatgctgcaacagcttgggaagtatgataagaatgcaagtcgttgtgtgcaaatacggaactggtttgactatcgtaaccatatctgtattgtatttgagaagcttggtccaagcttatacgattttctacgcaaaaacagttatcgctcatttccaattgatcttgtccgcgagtttgccagacaactattggaatgtgtagcatttatgcatgacatgcgcctcattcacactgatttaaagcctgagaatattcttcttgtttctccggagtacatcaaagtacctgattacaaagtgtcatcccgatctccgaaacagggttcctacttcaagagattgccaaaatcaagtgccatcaaggtgattgattttggaagcacaacttatgatcgtcacgacaatagttatgtagtgtctacgagacattattgggcacctgaggttatcttgggacttggatggagctatccctgtgatatttggagcgtcggttgtattcttgttgaactttgctcaggtgagactttgtttcagacccatgagaacttggaacatctggccatgatggagcgggttcttggaccgttaccttctaacatgctgcgacttgcagcccgagatgccgagaggtatgttcgaaggggtcatttgaattggcccgagggtgcaacctcaagagagagcatgaaagctgtgttgaaacttcctcggctgcagaatctggtgatgcagcactcggatcattcagctggggatttcatcgatcttttacaggggcttctgagatacgatcctgcagaccgattggcagcaaacgcagctctcttgcatcctttcttcacaagaaatcgctaa

SEQ ID NO: 157 - DNA, 1301 bp, Musa acuminata
cgatcatggagatcgaatgcttgaaggagtttccccaccctctgatggatcgccggccccggaagcgcccgaggttagggtgggacgttgacccccttaccgcggccaaggctcaaataggtatcttatgtggacaagaagttaacttgaagagcttggttccttcggggggtgcttcagatcacacttgtgcatcccagtctgcaaaggatcaggaacgagatgcttcccctccttggagaggagatgataaagatggacattacaagtttgaacttggagaaaatttaacctctcgctataagattcacagcaaaatgggtgaaggtacctttgggcaggttctggaatgttgggatagggaaagggaggaaatggtagccatcaaaattgtccggggcatcaataagtacagagaagctgctatgatagagattaatatgctgcaacagcttgggaagtatgataagaatgcaagtcgttgtgtgcaaatacggaactggtttgactatcgtaaccatatctgtattgtatttgagaagcttggtccaagcttatacgattttctacgcaaaaacagttatcgctcatttccaattgatcttgtccgcgagtttgccagacaactattggaatgtgtagcatttatgcatgacatgcgcctcattcacactgatttaaagcctgagaatattcttcttgtttctccggagtacatcaaagtacctgattacaaagtgtcatcccgatctccgaaacagggttcctacttcaagagattgccaaaatcaagtgccatcaaggtgattgattttggaagcacaacttatgatcgtcacgacaatagttatgtagtgtctacgagacattattgggcacctgaggttatcttgggacttggatggagctatccctgtgatatttggagcgtcggttgtattcttgttgaactttgctcaggtgagactttgtttcagacccatgagaacttggaacatctggccatgatggagcgggttcttggaccgttaccttctaacatgctgcgacttgcagcccgagatgccgagaggtatgttcgaaggggtcatttgaattggcccgagggtgcaacctcaagagagagcatgaaagctgtgttgaaacttcctcggctgcagaatctggtgatgcagcactcggatcattcagctggggatttcatcgatcttttacaggggcttctgagatacgatcctgcagaccgattggcagcaaacgcagctctcttgcatcctttcttcacaagaaatcgctaataa

SEQ ID NO: 158 - DNA, 1730 bp, Platanus occidentalis
aaaacagatcgatctgtttctgatctcgatctctctgcaagcgtttctacgtggtcatggagatggaatgcttgacggagtttcctcacactcacatggatcggcgtcccagaaagaggccgaggttagcttgggatgttcctcaggcaccaaaggctcagccaggaatattttgtgggcaagaggttggaaatcttacaagctttgcaccttcgagggcaccctcagaccatactagttctctgtttgtaaagggagtggctcgaaatggttctcccccatggcgagatgatgacaaagatggacattacatttttgcgcttggagaaaatttaacttctcgctataggattcacagcaaaatgggtgaagggacctttggtcaggttttagaatgctgggatagggaaaggaaggaaatggttgccatcaaaattgtccgtggtattaagaagtaccgtgaagcagcaatgatagaaattgaagttcttcaacagcttgggaaacatgataaaggaggcagccgttgtgtgcaaatacggaactggtttgactatcgtaaccatatctgtattgtatttgagaagcttggaccgagcttatacgattttctacggaaaaacaattatcgctcatttcccattgatctagcccgcgagcttggcagacaactgttggaatgtgtagcatttatgcatgatttgcatctgatccatacagacttgaagcctgagaacatactgctagtttctcctgaatatataaaagtaccagactacaaggtttcatctcgatcacctaaagatggctcgtactttaaaaggttgccaaagtcaagtgctatcaaggtaattgattttggtagcacaacatatgaacatcaggatcacagctacattgtatcaacaaggcactaccgtgcacctgaggttattcttggacttgggtggagttatccatgtgatatctggagtgtgggttgtatattggtggagctctgctcgggagaagcactgtttcagacccacgagaatttggagcacctcgccatgatggagagggtgttgggcccaattccgcagcacatgttgaagagagtggaccgccatgctgagaagtacgtcagaaggggaagactagattggcccgagggtgcgacttcaagggagagtattaaagctgttttgaagctgcctcggcttcagaacctggtaatgcagcatgtagatcactcggcaggggacctcatagatcttttgcaaggtctaataaagtatgatcctgtcgaccggctgactgctcgtgaagcccttaggcacccgttctttacgagggaccagcacaggagatcttgaaaaagcttataaagtttagtgaggatcctgaacacgtgaaatatttttatattgacgttcccgcgattgggaggtttggtaacagattcttgcttgtgggtcagaaggaatggggtcggacggggattgtcatggtatcatgcaaaaaatatctttgcttgagtattcctcgtgcctgtgctcatcaagggtgttggtactaaaccacgggatgctaagaagcctgctttttgctcccatcctgatgtatacgatattggtcttctggattgacagtagactaaatcatttttttttcctcttgtttgtataaagtaatcaataatgcgatccacttttgaattcatttttctcatcttctatgtctaatctatt

SEQ ID NO: 159 - DNA, 1665 bp, Vitis vinifera
ttcttgtgtttggtactcgagaaatttgattgtctcagggattttgtcttgctttctgtggagatatggagatggtggagcgcgtgaccgagtttcctcacacgcacatggatcgccggccgaggaagaggccgcgtttgggatgggatgttcttcctcaggctccaaaggctcagctagggatgttttgtggacaagaggttgggaatgtggcaagctttgcaccttcaaaggcacactccgaccaaactactagttctatgtttgtaaagggagtagctcgaaatggttctcccccatggcgagaagatgacaaagatggccattacatatttgcgcttggagaaaatttaacttctcgctataagatcaacagcaagatgggcgaaggaacctttggtcaggttttggaatgctgggacagagagaggaaggaaatggttgctgtcaaaattgtccgtggtattaagaagtatcgtgaggctgccatgattgaaattgaagtcttacaacagcttgctaaacatgacaagggtggcaatcgttgtgtgcaaatacggaactggtttgactatcgtaaccatatctgtattgtgtttgagaagcttggaccaagcttatacgattttctacggaaaaacaattatcgctcatttcccattgatcttgtccgtgagattggcagacaactgttggaatgtgtagcatttatgcatgatttacgcctcatacatacggatttgaagcctgagaatatacttctagtgtctccagaatatgttaaagttccagactacaaggtttcatcccgttcacccaaggatggttcttactttaagagagtaccaaaatcaagtgctattaaagtgattgattttggaagcacaacatatgagcgacaagatcagaactacattgtatcaacacggcattatcgtgcgccagaggttattcttgggcttggatggagttatccatgtgatatatggagtgttggatgtatcttggtggagttatgcacgggagaagcattgtttcagacccatgagaatctggagcaccttgccatgatggaaagggtgttgggtccactgccgcagcacatgctgaagagagtagaccgacatgcagagaagtatgtacgaaggggtagattggactggccagaaggtgcgacttcaagggaaagtatcaaagctgttctcaagctacctcgccttcagaacctaataatgcagcatgtggaccattcggctggagatctaatacatctgttgcaaggtcttcttagatatgacccttcagaccgattgacagccattggagccctaaggcatcccttctttacaagggatcacctcaggaggtcttgactttgagagcacattgatcaggatgcattgctggacagacttttgacggagagcacattaaccacaaagttccttttggtgatgtagagcccaagtttacaagaggctctctgctcgtgtaaatatgtccattgttatacaagatgaaagattagtccccatcatctctcaaaaatgtaattccaatttccttaaaaatgttggggctattctacccaagacaattctcaaatggtgtacaaccatgaatttcactaaccaatccctaattaatgttagatgacaagtaatt

SEQ ID NO: 160 - protein, 523 aa, Musa acuminata
MREGRPAWLLILGVVLLLFLSSLAEGSGQLTEPSFSRADFPLDFDFGAGTSSYQVEGAVSEDGRKPSIWDTFTHAGRMLDKSTGDVASDGYHKYKEDVKLMAETGLDSYRFSISWSRLIPNGRGAVNPKGLQFYNNLIDELVKYGIKPHVSLYHLDHPQALEDKYSGWLSPKMVDDFTAFADVCFKNFGDRVPRWTTIVEPNIMSLGAYDMGTLPPNRCSYPFGINCTVGNSTTEPYIAIHNVLLAHASIVKLYKSKYQAEQNGWIGINVYTFWYYPFTNSSADIEATQRILEFYVGWILNPLVFGDYPEVMKKFVGSRLPSFTKSQSEQIKGLFDFIGVNHYSSIYVKDNINASEMGLRDFVMDSLALVTTSRNETPGQYDPTAPSSFDPQGLQYMLEYLRDAYGNPPLFVEENGYGIGRRESDDLNDTDRINYLNGFIGSMLDAIRNGANVKGYFVWSFIDVFEFLTGYQSRCGLYHVDFDDENRKRKPKLSAIWYSKLLERKDGMKLNKTAMDTEYHARW

SEQ ID NO: 161 - protein, 408 aa, Musa acuminata
MAKTNLPPGFRFHPTDVELVWYYLKRKVMGKPFRSEAISEVELYKFAPWELPEKSRLRTRDLEWYFFCHRDKKYSNGSRSNRATDGGYWKATGKDKSVIHNSCTVGMRRTLVFHEGKPPKGTRTNWVMYEYRLESRELVDAGFAQDAYLLCKVFQKSGLGPRIGEQYGAPFNEEDWEDDTAIESSFPLPCVSSCLSAEPLDNQAIQADPVSKQPIASSAVELLSDHDLLDVDGILLEELAEFLNSSPLVENANGKMPDLTIPSMNVNEAAAMDPEGVYNELDDLSTGELISGNIDLIENILNETALCPTLQELDSKQYVELNDLIGDGNPYVSVEPSTPFAPNPSGHWPDLENLNHILDPIPYFDNDVYGGMRGLPHTGPDTTSQHWSPGMQIGDFGEFVPPLERSSF

SEQ ID NO: 162 - protein, 210 aa, Musa acuminata
MSDKNCGDHSKWCKLRKRFWRVLGCIVGFIILILLIILIIWLVLRPTKPRFYLQGAVVLQFNYTGPPSNLLSTVFQVTIASRNPNDRIGIYYDRIFVYAAYKNQQISLATALPPMYQGHNDVVIWSPYLFGPNVPVAPYLCDALTQDKASGFLILHVKIDGRIRWKVGSWTSDHYHLFVSCPAFLTFQNGRSGSGATVRFQQMSACSVEV

SEQ ID NO: 163 - protein, 323 aa, Musa acuminata
MSSLRASSSKLVWVAALVVSLMALCEAQLSPNYYDKTCPQVLPTVKKATGAAIAREHRMAASLLRLHFHDCFVQGCDASILLNDAAGIVSEKNARQNFRSARGYEVIDGIKSAVEKVCPGVVSCADILAIVARDSSVYVGGPSWKVKLGRRDSTTANKDLAEQNLPLAFDDLDTLTSVFARQGLSLKDMVVLSGSHTIGLAQCATFRGRIYNETNIDAGFARTRQRRCPPTAGNGDTNLAPLDLVTPGSFDNNYYKNLLSKKGLLHSDQLLFNGGSTDATVVAYSKDQAAFFADFAAAMVKMGDISPLTGSAGEVRKVCSVVN

SEQ ID NO: 164 - protein, 342 aa, Musa acuminata
MILRVEVMASSSSSSSSSFFLLLLGVALFLSNEATALPELPNLTTLAFEEGYTQLFGDSNLMLHRDGRSVHLSLDRRTGAGFASQDLYRHGFFSASIKLPADYAAGVVVAFYMSNGDVFEKTHDELDFEFLGNIRGREWRVQTNVYGNGSTAVGREERYGLWFDPTEDYHQYSILWSGERIIFYIDDIPIREVVRTQAMGGDFPSKPMSLYATIWDGSTWATSGGRYKVNYKYAPYEAEFADLVLHGCAVDPIEHRTTCLGSDAAVYDTITMSADQRTAMDKFRKKHITYSYCHDRVRYPTPPPECNLGPEAEDFLASGEAKLSYRRRRGKRYGRSSVDSVL

SEQ ID NO: 165 - protein, 164 aa, Musa acuminata
MAEEQRCQEGHRLCANNCGFFGSPATLNLCSKCYRDHRLKEEQERQQQPASSAAASAMLTVAKSFPASSPAVVVVDEEVSGASVPAAPPEETEKKKSAAEGPSRCARCRKRVGLTGFQCRCGATYCGVHRYAEQHDCTFDFKAAGRAAIARANPVVKADKLHKI

SEQ ID NO: 166 - protein, 381 aa, Musa acuminata
MGRQSCCYKQKLRKGLWSPEEDEKLIRHITKYGHGCWSSVPKQAGLERCGKSCRLRWINYLRPDLKRGTFSKQEESLIIELHAVLGNRWSQIASRLPGRTDNEIKNFWNSCVKKKLRQSGIDPNTHKPLAEMEDKTSNSGDLKAPATTLEKTKHSVHKPASSSSSSGESRTWKNSVTPTKGFFHDHESSSACHLSPLPQSGFAPDCAPLFEMNQELNCSTISTVLLSVPSGNISALMSLKPNIDLFRDEIDGIQCSSDVYLSNSRRSSMNTGSVIELQSSTSFDGGILPFSELTPEKNAHVQLEREHEDLKWSEYLQGTITASATIQSQSHPLQYDIKTESQSVLVGLGTWQQNQQGQQQLQSSNIYGKDFHMVSVGFGQV

SEQ ID NO: 167 - protein, 623 aa, Musa acuminata
MLEQLLIFTRGGLILWELGNALKGSPIDALIRSCLLEERSADAAFHYDAPAGCAAYTLKWAFDNDLGLVFVAVYQRILHLLYVDDLLAAARREFSRVYEPKRTSYDDFDETFRQLQKEAEARAEEMRRFKQAGRAPAAPGKKQVPGAASRGSGKQRSSGGGGSGKDESDGDPGKGRRSENGSSKGHENEIKPNSRAQNVVVHGKENGAPRVEAFDVSKLQKLRSKGAKKTDTGGGGCKAAKAEPKKIAKKNRVWDDSPSESRLDFTDPVDDRGEGPEVVVADQGESMMDKEEIVSSDSEGEEDEEVETEKPGTKKKGWFSSMLQSISGNAVLEKSDLRPALKALKDRLMTKNVAEEIAEKLCESVATSLEGKKLGSFTRVSSTVQTAMEEALLRILTPKRSIDILRDVHAAKEQGRPYVVVFVGVNGVGKSTNLAKVAYWLLQHKINVMLAACDTFRSGAVEQLRTHARRLQIPIFEKGYEKDPAIVANEAIQEAKRNNSDVVLVDTAGRMQDNEPLMRALSKLINLNNPDLVLFVGEALVGNDAVDQLTKFNQKLADLSMVPNARLIDGILLTKFDTIDDKVGAALSMVYVSGAPVMFVGCGQSYTDLKKLNIKSIVKTLLK

SEQ ID NO: 168 - protein, 469 aa, Musa acuminata
MRWENLLLLTPYHIMKPYSPELQNGSSRTSLQNTPRIVLLLTATLFLLTIIPLYLFPLLATSFAWRNLSSPPSSPSPSLSSSSSSSSSRDMSRDAMAGVTMAKSSCDIFRGEWVPNPNAPYYTNETCWAIHEHQNCMKFGRPDTEFMKWRWKPNDCDLPIFNPAQFLELVRGKSLAFVGDSVGRNQMQSLICLLLRVTYAVDASVTEDEKFRRYHFPTHNFTVASFWSPFLVRAHEADPNGPTLTGLFNLHLDQVDTNWTTQMTPFDYVIVSAGHWFFRPTMFFEADQLVGCHYCLHPNVTDLTMYYSYRRAFRAALRAFNDLPGFRGTVFLRTFAPSHFENGEWNKGGNCVRQRPFRGNETRMDGYNLEMYMAQLEEYRAAEGEGKEKGVRFRLLDTTEAMLLRPDGHPGRFGHRPDENVTLYNDCVHWCLPGPIDAWNDFLLHMLKNEGGRSAAGRRSRNDRKSTIK

SEQ ID NO: 169 - protein, 267 aa, Musa acuminata
MDLSGQEGEIPIPITSVYVGGHGHGSIHDSPPIHHPSNGPPPPPLSTATTEDHHHNTTNSYSTKKGVVVRYRECLKNHAASIGGNATDGCGEFMPSGEEGTLEALKCSACSCHRNFHRKETEGEPCCDWFYPLRGRKVMGHKGLLISGSDAFGYSPACNSLIPRATPHNMIMPLGVMQTSESDEMEGVGAMMARPVVVKKRFRTKFTPEQKEKMLSFAEKVGWRLQKQEESVVQQFCQEIGVKRRVLKVWMHNNKHHLAKKNSLQLE

SEQ ID NO: 170 - protein, 400 aa, Musa acuminata
MARLGGEATLTSRLLFFFLLSTAVMGGSATVETRRSVLGNGLGRTPPMGWNSWNHFHCNINERLIRETADALVHTGLAGLGYRYVNIDDCWGEANRDYQGNLVAKRSTFPSGIKSLADYVHAKGLKLGIYSDAGSQTCSRTMPGSLGYEQHDATTFASWGVDYLKYDNCNNPGTRPRERYAKMSYALRNSGRNIFFSLCEWGVDNPATWASGIGNSWRTTGDIYDSWGSMTSRADENNRWASYAGPGGWNDPDMLEVGNGGMSTEEYRSHFSIWALVKAPLLIGCDVRTISGDALEILSNSEVIAVNQDYLGVQGKKVFGGGSEEVWAGRLSGGKVAVVLWNRGSSRATITARWSDIGLSSSTAVSVRDLWARATIGSVRGQLAATVAPHACKMYVLTPR

SEQ ID NO: 171 - protein, 263 aa, Musa acuminata
MEGVFADCYASSIISQNAITDSSPGSCDFFASRQSVMSALLLDIAWLMKAPHLEDKEAFRSLTNVQRLTSLLKFLLQNELFSVLQVIMHHLDSIVDVDGFDKLDKWTDVDQKLFHEYLNHAREILYERTHDMRSEAEMRNPICGLVPQSSQSNMCGEIYTKQGNEAIKDCLFLVSFQPAVEHDVNVLLVNEEISHRQHCHHNLGKKCAFDDIFSNKITRTRFPLFVIVTVVLCLAACIILLHPHEVGEIAVSIRRCMFGGSPA

SEQ ID NO: 172 - protein, 511 aa, Musa acuminata
MRKESLALLATLVLLLPTTESKLSRDDFPPGFIFGAGTSAYQVEGAAAEDGRTPSIWDTYTRAGGMLDNSTGDVTSDQYHKYKEDVKLMVDTGLDSYRFSISWSRLLPNGRGAINPKGLAYYNNLIDELLRYGITPHVTIYHYDLPQVLEDEYEGWLSHKIVEDFTAFADVCFREFGDRVSQWTTIAEPNVIAIGSFDNAIFPPSRCSNPFGLFNCTVGDSTTEPYTAAHNFLLAHASVVSLYRTKYQAKQNGRIGLNVYSMWCYPSTNSTLDLQATQRLLDFYVGWIINPLVFGDYPKVMKKIVRSRLPSFTEEQSEQLKGSFDFIGLNHYSSIWVKDNSNASETAPRDFNADLFAKFAFSKNDTPGSQLVPTDIPFDPAGLQHLLEYIRDAYGNPPVYIEENGYGLGLNDTISDVKRANYLSGYIGSTLDGIRKGANVKGYYVWSFLDVFEFLSGFQSPFGLYHVDFKDENRTRQPKLSALWYSDFLKKKKTSTNINMMGLHQRSHSQR

SEQ ID NO: 173 - protein, 390 aa, Zea mays
MGTNDRAVISLVLLVCIASRSSLGAAETDVEQKRLSVPLMFVFGDSLVDVGNNNFLPPPAPRAASPYGIDFPAGTPGAVSGRFTNGYNLADLVARRLGFKMSPPAYLSLTPVSKFDLFTCRIGANYASGGSGILNTTGNGTLTLQKQITLFSKTQARMSWARCKLRSMVSRSLFLISAGGNDFSAFSEMGMGEQDAPAYISSMVSTYVQHIDALYKLGARRLGILDVPAIGCTPGSRVPMANGGCNDAANSMAQNFNKLLRLEVAKAVASSMPGMRYSIASTYNFVTDLMDSHLVAGLRVVDRACCGSGKLNAAVMCAQPNTTYCSDRDDYMFWDMLHPTQATNERGVVAIFYGPQEYADPINFAQLAAATANDDDDINTAMTAGVYAAI

SEQ ID NO: 174 - protein, 558 aa, Triticum aestivum
MALTSHLLVVLLGIAVPLLFFSRAEGGEVGVCYGRMATNLPDPATVVQLLKKNSITMVRIYDTDPTVLRSLANTGIKVTVELTNEELPSAATDQNFADQWVQNNVKAYYPATLINGVTIGNEVFKEASQLNSQLVPAMKKVQAALARLGLADAVKVTTPIAFDALKMSFPPSEGAFRDDIALSVMSPMVDFLQETGSYLMMNIYPYLAYLSTPGMSIDYLLFRPNVGVVDKNSKQTYFSLLDAQLDAVYYAMEKLPSSSLRAGGMRKLTAGGGILEVKLGESHHPTRGHHGVGTRANAQAFTDGLMSKVRGGNSGTTSNKYNRLATSAVGTPHRPNADLDVYIFELFNEDNKPEDEQDFGLFYPNQQPVYQVDFVHGAGPVQPSYCTAKATAGDAALQAALDYACGHGADCSAIQPGKPCYKPNTKLAHASYAFNDYYQKNGRASSACDFGGAGTIVNQAPSGRCDLSPSWCVANAAVGAARLQNALDYACGHGADCTDIQPGARCFDPDTKVAHASFAFNDYYQRHNQAAGTCDFAGAGTIVRQAPKIGNCVLPSRA

SEQ ID NO: 175 - protein, 230 aa, Triticum aestivum
MAALTGAALLLASLLALAAITSGNTEGDILYSQRQAWKDPNNVLQSWDPTLVNPCTWYHVTCNNVNSVIRVDLGNAGLSGALVPGLGRMVNLQYLELFGNNISGPIPATLGNLTRLVSLDLYDNRLTGAIPASLGNIETLRFLRLHGNKLAGGIPASLGRLKKLQALELQENMLSGTVPREVLSLVLVGDLTELNVAKNSLAGTVKSSKPRVATVIQDTLKTTRLHAEQH

SEQ ID NO: 176 - protein, 96 aa, Triticum aestivum
MKNSTLVAILVVLQAIMVIGILSHAADDNFPKCCDHCNSWSGYQFCDDVGPRCRDGCVNCHVVETSPVKTFRCGDGRPVLGGQGTPTPCPPPCKKH

SEQ ID NO: 177 - protein, 1359 aa, Oryza sativa
MWHLRGRSSVTAAAAAALHKPVAHLRLLLAVSAWSVPAAASNVAAASTTTRGGPSPSAGVAPRAMPSSSSSPPSAAEGTTAAAGGFRLTEPSFLESLMPKKEIGVDRFLAAHPEYDGRGALIAIFDSGVDPAAAGLQTTSDGKPKILDVIDCTGSGDVDTSKVVKADDDGSIVGASGTHLTINPSWKNPSQEWHVGCKLVYELFTDTLTSRLKKERKKKWDEHNQEAISEALKQLNEFEKKHSKSDDAKQKMAREDLQSRLEYLRKQAEGYDDRGPVIDIVAWHDGDVWRVAVDTQGLEGNKNCGKLADFVPLTNYRLERKFGIFSKLDACSFVANIYDDGNLVSIVTDCSPHATHVAGIAAAFHPDEPLLNGVAPGAQLISCKIGDTRLGSMETGTGLVRALIAAVEHKCDLINMSYGEPTLLPDYGRFIDLASEVVDKHRIIFISSAGNNGPALNTVGAPGGTSSSIIGVGAYVSPAMAAGAHCVVQAPAEGMEYTWSSRGPTADGDLGVSISAPGGAVAPVPTWTLQSRMLMNGTSMSSPSACGGVALLVSAMKAEGIPLSPYTVRKAIENTAASISDVPEEKLTTGHGLLQVDRAFEYAQQAKELPLVSYRISINQVGKPTSKLRGIYLRGSNTCRQTSEWTVQLDPKFHEDASNMEQLVPFEECLQLHSTDSSVIKIPEYIMVTNNGRTFNIVVNPVNISSGLHYYEVYGIDCKAPWRGPIFRVPITVIKPIALSGEPPALTLSNLSFKSGHIERRFINVPIGASWVEVTMRTSAFDTPRRFFLDTVQICPLKRPIKWEAVVTFSSPSLKNFSFPVEGGLTLELSIAQFWSSGIASHEPTCVDFEIVFHGISVDQKIIGLDGSEAPVRVVARSLLASERLVPVATLNKVKTPYRPVESNLCSLPPSRDRLPSGKQIIALTLTYKFKLEDGAEIKPRVPLLNNRIYDNKFESQYYRISDSNKCVYSSGDVYPNYVKLSKGEYTLQLYIRHDNVQLLEKLKQLVLFIERKLEKKDFIQLSFYSEPDGPTVGNGTFKSSILVPGEPEAFYVGPPSREKLPKNVLPGSVLVGSITYGAVSSFSKKDDQNQHAPASYSISYLIPPSKVDNDKEKGVSSGRKSISERLDDEVRDTKIKFLSGFNQETEDDKSSWTALVASLKPEYPKYTPLLAKILECIVQKATSDDKFSHQKEIIAAADEVVDSIDKEDLAKSLSLKPDPEDEEAQKNKKKMEETRDQLADALYQKGLALAEIESLKTDESTEASAKDVFEENYKELIKWVDAKTTKYGSLTVLRERRCGRLGTALKVLNDMIQDDSEQPKKRLYDLKIQLIEEIGWVHVSAYEKQWMHVRFPPSLPPF

SEQ ID NO: 178 - protein, 523 aa, Musa acuminata
MREGRPAWLLILGVVLLLFLSSLAEGSGQLTEPSFSRADFPSDFIFGAGTSSYQVEGAVSEDGRKPSIWDTFTHAGRMLDKSTGDVTSDGYHKYKEDVKLMAETGLDSYRFSISWSRLIPNGRGAVNPKGLQFYNNLIDELVKYGIKPHVSLYHLDHPQALEDEYSGWLSPKMVDDFTAFADVCFKNFGDRVPRWTTVVEPNIMSMGAYDVAILPPNRCSYPFGINCTVGNSTTEPYIVVHNVLLAHASIVKLYKSKYQVEQNGWIGINVYTFWYYPLTNSSADIEATQRMLEFYVGWILNPLVFGDYPEVMKKIVGSRLPSFTKSQSKQIKGLFDFIGVNHYSSIYVKDNINASEMGLRDFALDSLALMITSRNETPGQYDPTAPSSFDPQGLQYMLEYLRDAYGNPPLFVEENGYGIGRIESDGLNDTDRINYLNGFIGSMLDAIRNGANVKGYFIWSFIDVFEFLTGYQSRCGLYHVDFDDENRKRKPKLSAGWYSKLLEGKDGMKLNKTAMDTEYHARW

SEQ ID NO: 179 - protein, 408 aa, Musa acuminata
MAKTNLPPGFRFHPTDVELVWYYLKRKVMGKPFRSEAISEVELYKFAPWELPGKSRLRTRDLEWYFFCHRDKKYSNGSRSNRATDGGYWKATGKDKSVVHNSCTVGMRRTLVFHEGKPPKGTRTNWVMYEYRLESRELVDAGFAQDAYLLCKVFQKSGLGPRIGEQYGAPFNEEDWEDDTAIESSFPLPCVSSCLSAEPLDNQAIQADPVSKQPIASSAVELLSDHDLLDVDGISLEELAEFLNSSPLVENANDKMPDLTIPSMNVNEAAAMVPEGVYNELDDLSTGELISGNIDLIENILNETALCPTLQELDSKQYVELNDLIGDGNPYVSVEPSTPFAPNPSGHWPDLENLNHILDPIPYFDNDVFGGMRGLPHTGPDTTSQHWSPGMQIGDFGEFVPPLERSSF

SEQ ID NO: 180 - protein, 210 aa, Musa acuminata
MSDKNCGDHSKWWKLRKRFWRILGCIVGFIILILLIILIIWLVLRPTKPRFYLQSAVVLQFNYTGPPSNLLSTVFQVTIASRNPNDRIGIYYDRIFVYAAYKNQQISLATALPPMYQGHNDVVIWSPYLFGPNVPVAPYLCDALTQDKASGFLILHVKIDGRIRWKVGSWTSDHYHLFVSCPAFLTFQTGRSGSDATVRFQQMSACSVEV

SEQ ID NO: 181 - protein, 323 aa, Musa acuminata
MSSLRASSSKLVWVAALVVSLMALCEAQLTPNYYGKTCPQVLPTVKKATGTAIAREHRMAASLLRLHFHDCFVQGCDASILLNDAAGIVSEKNARQNFRSARGYEVIDGIKSAVGKVCPGVVSCADILAIVARDSSVYVGGPSWKVKLGRRDSTTASKDLAEQNLPIAFDDLDTLTSVFARQGLSLKDMVVLSGSHTIGLAQCATFRGRIYNETNIDAGFARMRQRRCPPTAGNGDTDLAPLDLVTPGSFDNNYYKNLLGKKGLLHSDQLLFNGGSTDATVVAYSKDQAAFFADFAAAMVKMGDISPLTGSAGEVRKVCSVVN

SEQ ID NO: 182 - protein, 338 aa, Musa acuminata
MILRVEVMASSSSSFFLLLLGVALFLSNEATALPELPNLTTLAFEEGYTQLFGDSNLMLHRDGRSVHLSLDRRTGAGFASQDLYLHGFFSASIKLPADYAAGVVVAFYMSNGDVFEKTHDELDFEFLGNIRGREWRVQTNVYGNGSTAVGREERYGLWFDPTEDYHQYSILWSGERIIFYIDDIPIREVVRTQAMGGDFPSKPMSLYATIWDGSTWATSGGRYKVNYKYAPYEAEFADLVLHGCAVDPIDHRTTCLGSDAAVYDTITMSADQRTAMGKFRKKHITYSYCHDRVRYPTPPPECNLGPEAEDFLASGEAKLSYRRRRGKRHGRSSVDSVL

SEQ ID NO: 183 - protein, 164 aa, Musa acuminata
MAEEQRCQEGHRLCANNCGFFGSPATLNLCSKCYRDHRLKEEQERQQQPAPSAAASAMLTVAKSFPASSPAVVVVDEEVSGASVPADPPEETEKKKSAAEGPSRCARCCKRVGLTGFQCRCGATYCGVHRYAEQHDCTFDFKAAGRAAIARDNPVVKADKLHKI

SEQ ID NO: 184 - protein, 381 aa, Musa acuminata
MGRQSCCYKQKLRKGLWSPEEDEKLIRHINKYGHGCWSLAPKQAGLERCGKSCRLRWINYLRPDLKRGTFSKQGESLIIELHAVLGNRWSQIASRLPGRTDNEIKNFWNSGVKKKLRQSGIDPNTHKPLAEMEDKTSNSGDLKAPATTLEKTKHSVHKPASSSSSSGESRTWKNSVTPTKGFFHDHESSSACHLSPLPQSGFAPDCAPLFEMNQELNCSTISTVLLSVPSGNISALMSLKPNIDLFRDEIDGIQCSSDVYLSNSRRSSMNTGSVIELQSSTSFDGGILPFSELTPEKNAHVQLEREHEDLKWSEYLQGTITASATIQSQSHPLQYDIKTESQSVLVGLGTWQQNQQGQQQLQSSNIYGKDFHMVSVGFGQV

SEQ ID NO: 185 - protein, 623 aa, Musa acuminata
MLEQLLIFTRGGLILWELGNALKGSPIDALIRSCLLEERSADAAFHYDAPAGCAAYTLKWAFDNDLGLVFVAVYQRILHLLYVDDLLAAVRREFSRVYEPKRTSYDDFDETFRQLQKEAEARAEEIRKFKQAGRAPAAPGKKQVPGAASRGSGKQRSSGGGGSGKDESDGDPGKGRRSENGSSKGHENEIKPNSRAQNVVVHGKENGAPQVEAFDVSKLQKLRSKGAKKTDTGGGGCKAAKAEPKKIAKKNRVWDDSPSESRLDFTDPVDDRGEGPEIVVADQGESMMDKEEIVSSDSEGEEDEEVRNEKPDTKKKGWFSSMLQSISGNALLEKSDLRPALKALKDRLMTKNVAEEIAEKLCESVATSLEGKKLGSFTRVSSTVQTAMEEALLRILTPKRSIDILRDVHAAKEQGRPYIVVFVGVNGVGKSTNLAKVAYWLLQHKINVMLAACDTFRSGAVEQLRTHARRLQIPIFEKGYEKDPAIVAKEAIQEAKRNNSDVVLVDTAGRMQDNEPLMRALSKLINLNNPDLVLFVGEALVGNDAVDQLTKFNQKLADLSMVPNARLIDGILLTKFDTIDDKVGAALSMVYVSGAPVMFVGCGQSYTDLKKLNIKSIVKTLLK

SEQ ID NO: 186 - protein, 469 aa, Musa acuminata
MRWENLLLLTPYHIMKPYSPELQNGSSRTSLQNTPRIVLLLTATLFLLTIIPLYLFPLLATSFAWRNLSTPPSSPSPSLSSSSSSSSSRDMSRDAMAGVTMAKSSCDIFRGEWVPNPNAPYYTNETCWAIHEHQNCMKFGRPDTEFLKWRWKPNDCDLPIFNPAQFLELVRGKSLAFVGDSVGRNQMQSLICLLLRVTYAVDASVTEDEKFRRYHFPTHNFTVASFWSPFLVRAHEADPNGPTLTGLFNLHLDQVDTNWTTQMTPFDYVIVSAGHWFFRPTMFFEADQLVGCHYCLHPNVTDLTMYYSYRRAFRAALRAFNDLPGFRGTVFLRTFAPSHFENGEWNKGGNCVRQRPFRGNETRMDGYNLEMYMAQLEEYRAAEGEGKEKGVRFRLLDTTEAMLLRPDGHPGRFGHRPDENVTLYNDCVHWCLPGPIDAWNDFLLHMLKNDGGRSAAGRRSRSDRKSTIK

SEQ ID NO: 187 - protein, 267 aa, Musa acuminata
MDLSGQEGEIPIPITSVYVGGHGHGSIHDSPPIHHPSNGPPPPPLSTATTEDHHHDTTNSYSTKKGVVVRYRECLKNHAASIGGNATDGCGEFMPSGEEGTLEALKCSACSCHRNFHRKETEGEPCCDWFYPLRGRKVMGHKGLLISGSDAFGYSPACNSLIPRATPHNMIMPLGVMQTSESDEMEGVGAMMARPVVVKKRFRTKFTPEQKEKMLSFAEKVGWRLQKQEESVVQQFCQEIGVKRRVLKVWMHNNKHHLAKKNSLQLE

SEQ ID NO: 188 - protein, 400 aa, Musa acuminata
MARLGGEATLTSRLLFFFLLSTAVMGGSATVETRRSVLGNGLGRTPPMGWNSWNHFHCNINERLIRETADALVHTGLAGLGYRYVNIDDCWGEANRDYQGNLVAKRSTFPSGIKSLADYVHAKGLKLGIYSDAGSQTCSRTMPGSLGYEQHDATTFASWGVDYLKYDNCNNPGTRPRERYAKMSYALRNSGRNIFFSLCEWGVDNPATWASGLGNSWRTTGDIYDSWGSMTSRADENNRWASYAGPGGWNDPDMLEVGNGGMSTEEYRSHFSIWALVKAPLLIGCDVRTISGDALEILSNSEVIAVNQDYLGVQGKKVFGGGSEEVWAGRLSGGKVAVVLWNRGSSRATITARWSDIGLSSSTVVSVRDLWARATIGSVRGQLAATVAPHACKMYVLTPR

SEQ ID NO: 189 - protein, 513 aa, Musa acuminata
MRKESLALLATLVLLLPTAESNLSRDDFPPGFIFGAGTSAYQVEGAAAEDGRTPSIWDTYTRAGGMLDNSTGDVTSDQYHKYKEDVKLMVDTGLDSYRFSISWSRLLPNGRGAINPKGLAYYNNLIDELLRYGITPHVTIYHYDLPQVLEDEYEGWLSHKIVEDFTAFADVCFREFGDRVSQWTTIVEPNVMAIGSFDNAIFPPGRCSNPFGLFNCTVGDSTTEPYTAVHNFLLAHASVVSLYRTKYQAKQNGRIGLNVYSMWCYPSTNSTLDLQATQRLLDFFVGWIINPLVFGDYPKVMKKIVRSRLPSFTEEQSEQLKGSFDFIGLNHYSSIWVKDNSDASETAPRDFNADLFAKFAFSKNDTPGSELVPTDIPFDPAGLQHLLEYIRDAYGNPPVYIEENGYGLGLNGTISDVKRANYLSGYIGSTLDGIRKGANVKGYYVWSFLDVFEFLSGFQSPFGLYHVDFKDENRRRQPKLSALWYSDFLKKKKKKTSTNINMMGLHQRSHSQR

SEQ ID NO: 190 - protein, 390 aa, Zea mays
MGTNYRAVISLVLLVCIASRSSLGAAETDVEQKRSSVPLMFVFGDSLVDVGNNNFLPPPAPRAASPYGIDFPSGTPGAVSGRFTNGYNLADLVARRLGFKMSPPAYLSLTPVSKFDLFTCRIGANYASGGSGILNTTGNGTLTLQKQITLFSKTKARMSWGRCKLSSMVSRSLFLISAGGNDFSAFSEMGMGEQDAPAYISSMVSTYVQHIDALYKLGARRLGILDVPAIGCTPGSRVPMANGGCNDAANSMAQNFNKLLRLEVAKAVASSMPGMRYSIASTYNFVTDLMDSHLVAGLRVVDRACCGSGKLNAAVMCAQPNTTYCSDRDDYMFWDMLHPTQATNERGVVAIFYGPQEYADPINFAQLAAATANDDGDINTAMTAGVYAAI

SEQ ID NO: 191 - protein, 558 aa, Triticum aestivum
MALTSHLLVVLLGIAVPLLFFSRAEGGEVGVCYGRMATNLPDPATVVQLLKKNSITMVRIYDTDPTVLRSLANTGIKVTVELTNEELPSAATDQNFADQWVQNNVKAYYPATLINGVTIGNEVFKEASQLNSQLVPAMTKVQAALARLGLADAVKVTTPIAFDALKMSFPPSEGAFRDDIALLVMSPMVNFLQETGSYLMMNIYPYLAYLSTPGMSIDYLLFRPNVGVVDKNSKQTYFSLLDAQLDAVYYAMEKLPSSSLRAGGMRKLTAGGGILEVKLGESHHPTRGHHGVGTRANAQAFTDGLMSKVRGGNSGTTSNKYNRLATSAVGTPHRPNADLDVYIFELFNEDNKPEDEQDFGLFYPNQQPVYQVDFVHGAGPVQPSYCTAKATAGDAALQAALDYACGHGADCSAIQPGKPCYKPNTKLAHASYAFNDYYQKNGRASSACDFGGAGTIVNQAPSGRCDLSPSWCVANAAVGAARLQNALDYACGHGADCTDIQPGARCFDPDTKVAHASFAFNDYYQRHNQAAGTCDFAGAGTIVRQAPKIGNCVLPSRA

SEQ ID NO: 192 - protein, 408 aa, Musa acuminata
MAKTNLPPGFRFHPTDVELVWYYLKRKVMGKPFRSEAISEVELYKFAPWELPEKSRLRTRDLEWYFFCHRDKKYSNGSRSNRATDGGYWKATGKDKSVIHNSCTVGMRRTLVFHEGKPPKGTRTNWVMYEYRLQSRELVDAGFAQDAYLLCKVFQKSGLGPRIGEQYGAPFNEEDWEDDTAIESSFPLPCVSSCLSAEPLDNQAIQADPVSKQPIASSAVELLSDHDLLDVDGISLEELAEFLNSSPLVENADGKMPDLTIPSMNVNEAAAMDPEGVYNELDDLSTGELISGNIDLIENILNETALCPTLQELDSKQYVELNDLIGDGNPYVSVEPSTPFAPNPSGHWPDLENLNHILDPIPYFDNDVYGGMHGLPHTGPDTTSQHWLPGMQIGDFGEFVPPLERSSF

SEQ ID NO: 193 - protein, 210 aa, Musa acuminata
MSGKDCGDHSKWWKLRKRFWRILGCIVGFIILILLIILIIWLVLRPTKPRFYLQGAVVLQFNYTGPPSNLLSTVFQVTIASRNPNDRIGIYYDRIFVYAAYKNQQISLATALPPMYQGHNDVVIWSPYLFGPNVPVAPYLCDALTQDKASGFLILHVKIDGRIRWKVGSWTSDHYHLFVSCPAFLTFQNGRSGSGAAVRFQQMSACSVEV

SEQ ID NO: 194 - protein, 210 aa, Musa acuminata
MTAKDCGQHGECCERRKRNRRIFGCILATIIVILLIILIVWLALRPTKPRFYLQDAVVLQFNYTGPPSNLLSTVIQVTLSSRNPNDRVGIYYDRLDVYAAYKYQQISVASALPPMYQGHNDIDVWSPYLYGPDVPVAPYLCDPLTQDESSGFLLLHVKIDGRIRWKVGSWISGHYHLFVSCPAFLTFQNGRSGSGATVKFQQMSSCSVEV

SEQ ID NO: 195 - protein, 323 aa, Musa acuminata
MSSLRASSSNLVWVAALVVSLMALCEAQLSPNYYDKTCPQVLPTVKKATGTAIAREHRMAASLLRLHFHDCFVQGCDASILLNDAAGIVSEKNARQNFRSARGYEVIDGIKSAVEKVCPGVVSCADILAIVARDSSVYVGGPSWKVKLGRRDSTTASKDLAEQNLPIAFDDLDTLTSVFARQGLSLKDMVVLSGSHTIGLAQCATFRGRIYNETNIDAGFARMRQRRCPPTAGNGDTNLAPLDLVTPGSFDNNYYKNLLRKKGLLHSDQLLFNGGSTDATVAAYSKDQAAFFADFAAAMVKMGDISPLTGSAGEVRKVCSVVN

SEQ ID NO: 196 - protein, 342 aa, Musa acuminata
MILRVEVMASSSSSSSSSFFLLLLGVALFLSNEATALPELPNLTTLAFEEGYTQLFGDSNLMLHRDGRSVHLSLDRRTGAGFASQDLYRHGFFSASIKLPADYAAGVVVAFYMSNGDVFEKTHDELDFEFLGNIRGREWRVQTNVYGNGSTAVGREERYGLWFDPTEDYHQYSILWSGERIIFYIDDIPIREVVRTQAMGGDFPSKPMSLYATIWDGSTWATSGGRYKVNYKYAPYEAEFADLVLHGCAVDPIEHRTTCLGYDAAVYDSITMSADQRTAMDKFRKKHITYSYCHDRVRYPTPPPECNLGPEAEDFLASGEAKLSYRRRRGKRYGRSPVDSVL

SEQ ID NO: 197 - protein, 340 aa, Musa acuminata
MASSSSSSSSSSALFFYYLLLLGSALFLTNEATALPEVPNLTTLSFEEGYTQLFGDSNLILHQDGQTVHLSLDQRTGAGFASQGLYLHGFFSASIKLPADYAAGVVVAFYMSNGDVFEKTHDELDFEFLGNIRGREWRVQTNVYGNGSTAVGREERYGLWFDPTEDYHQYSILWSNERIIFYIDNTPIREVVRTQTMGGDFPSKPMSLYATIWDGSTWATSGGRYKVNYKFAPYVAEFTDLVLHGCVVDPSNHNRTCLESNAGVYNAMMISTDQRAAMERFRKKHMTYSYCHDRIRYLTPSPECSLGPETKSFLITGEARSSYHHHHGKRNGRSTVDVAL

SEQ ID NO: 198 - protein, 164 aa, Musa acuminata
MAEEQRCQEGHRLCANNCGFFGSPATLNLCSKCYRDHRLKEEQERQQQPASSSAASAMLTVAKSFPASSPAVVVVDEEVSGASVPAAPPEETEKKKSAAEGPSRCARCRKRVGLTGFQCRCGATYCGVHRYAEQHDCTFDFKAAGRAAIARANPVVKADKLHKI

SEQ ID NO: 199 - protein, 381 aa, Musa acuminata
MGRQSCCYKQKLRKGLWSPEEDEKLIRHITKYGHGCWSSVPKQAGLERCGKSCRLRWINYLRPDLKRGTFSKQEESLIIELHAVLGNRWSQIASRLPGRTDNEIKNFWNSCVKKKLRQSGIDPNTHKPLAEMEDKTSNSGDLKAPATTLEKTKHSVHKPASSSSSSGESRTWKNSVTPTRGFFHDHESSSACHLSPLPHSGFAPDCAPLFEMNQELNCSTISTVLLSVPSGNISALMSLKPNIDLFRDEIDGIQCSSDVYLSNSRRSSMNTGSVIELQSSTSFDGGILPFSELTPEKNAHVQLEREHEDLKWSEYLQGTITASATIQSQSHPLQYDIKTESQSVLVGLGTWQQNQQGQQQLQSSNIYGKDFHMVSVGFGQV

SEQ ID NO: 200 - protein, 623 aa, Musa acuminata
MLEQLLIFTRGGLILWELGNALKGSPIDALIRSCLLEERSADAAFHYDAPAGCAAYTLKWAFDNDLGLVFVAVYQRILHLLYVDDLLAAARREFSRVYEPKRTSYDDFDETFRQLQKEAEARAEEMRRFKQAGRAPAAPGKKQVPGAASRGSGKQRSSGGGGSGKDESDGYPGKGRRSENGSSNGHENEIKPNSRAQNVVVHGKENGAPRVDAFDVSKLQKLRSKGAKKTDTGGGGCKAAKAEPKKIAKKNRVWDDSPSESRLDFTDPVADRGEGPEVVVADQGESMMDKEEIVSSDSEGEEDEEVGNEKPGTKKKGWFSSMLQSISGNAVLEKSDLRPALKALKDRLMTKNVAEEIAEKLCESVATSLEGKKLGSFTRVSSTVQTAMEEALLRILTPKRSIDILRDVHAAKEQGRPYVVVFVGVNGVGKSTNLAKVAYWLLQHKINVMLAACDTFRSGAVEQLRTHARRLQIPIFEKGYEKDPAIVANEAIQEAKRNNSDVVLVDTAGRMQDNEPLMRALSKLINLNNPDLVLFVGEALVGNDAVDQLTKFNQKLADLSMVPNARLIDGILLTKFDTIDDKVGAALSMVYVSGAPVMFVGCGQSYTDLKKLNIKSIVKTLLK

SEQ ID NO: 201 - protein, 628 aa, Phoenix dactylifera
MLEQLLIFTRGGLILWTYRELGNALKGSPVDALIRSCLLEERSAETSFSYEAPAGGGSYTLKWAFHNDLGLVFVAIYQRILHLLYVDDLLAAVRREFSQIYDPKRTAYDEFDEIFRQLQKEAEARAEEMRKSKQFNRAPLVAGKKQRPGQRAGSQGNGKQKGGKVGSGKDDADGESGKGRGLSNGSSNGQENGIKEPSRAPSVLVKGKENGAPEVGAFDVNKLQKLRPKGGKKTDAGGGGGKASKAESKKMVKKNRVWDDSPPESRLDFTDPADEKGDSIVDVVATDQGESMMDKEEIVSSESESEEDEGVESAKPGTKKKGWFSSMFQSIAGNAVLEKSDLTPALKALKDRLMTKNVAEEIAEKLCESVAASLEGKKLGSFTRVSSTVQTAMEEALLRILTPKRSIDILRDVHAAKEQGKPYVVVFVGVNGVGKSTNLAKVAYWLLQHNISVMMAACDTFRSGAVEQLRTHARRLQIPIFEKGYEKDPAIVAREAIQDASRHSSDVVLVDTAGRMQDNEPLMRALSKLINLNNPDLVLFVGEALVGNDAVDQLSKFNQKLADLSTVPNARLIDGILLTKFDTIDDKVGAALSMVYISGAPVMFVGCGQSYTDLKKLNVKSIVKTLLK

SEQ ID NO: 202 - protein, 621 aa, Cocos nucifera
MLEQLLIFTRGGLILWTCGNALKGSPIDALIRSCLLEERSAETFFSYDAPAGGAAYNLKWAFHNDLGLVFVAVYQRILHLLYVDDLLAAVRREFSQIYDPKRTAYDEFDEIFRQLQKEAEARAEEMRKSKQSNRAPLMAGKKQGAGAGQRAGSQGNAKQKGGKGSSGKDDGDGELGKGRGLSNGQENGTKEHSRAPSVVVKGKENGAPVSGAFDVNKLQKLRPKGGKKTDTGTGKASKAEPKKIVKKNRVWDDSPSDSKLDFTDPADEKGDEVVDFGKADHGESMMDKEEIVNSESESEEDEEVESAKPGTKKKGWFSSMFQSIAGNAVLDKADLKPALKALKDRLMTKNVAEEIAEKLCESVAASLEGKKLGSFTRVSSTVQTAMEEALLRILTPKRSIDILRDVHAAKEQGKPYVVVFVGVNGVGKSTNLAKVAYWLLQHDISVMMAACDTFRSGAVEQLRTHARRLQIPIFEKGYEKDPAIVAREAILEASRNNSDVVLVDTAGRMQDNEPLMRALSKLINLNNPDLVLFVGEALVGNDAVDQLSKFNQKLADLSTVPNARLIDGILLTKFDTIDDKVGAALSMVYISGAPVMFVGCGQSYTDLKKLNVKSIVKTLLK

SEQ ID NO: 203 - protein, 628 aa, Elaeis guineensis
MLEQLLIFTRGGLILWTYRELGNALKGSPVDALIRSCLLEERSAETSFSYDAPVGGAAYTLKWAFHNDLGLVFVAVYQRILHLLYVDDLLAAVRREFSQIYDPKRTAYDEFDEIFRQLQKEAEARAEEMRKSKQSNRALPVAGKKQGPGQRAGSQGNGKQKGAKVCSGKDDGDGESGEGRGLSKGSSNGQENGIKESSRAPSVVVKGKEDGTPEVGAFDVNKLQKLRSKGGKKSDAGGGGGKASKAELKKIVKKNRVWDDSPSKSRLDFTDPGDEKGDNIADVVTADQGESMMDKEEIVSSESESEEDEELECAKSGTKKKGWFSSMFQSIAGNAVLERSDLTPALKALKDRLMTKNVAEEIAEKLCESVAASLEGKKLGSFTRVSSTVQTAMEEALLRILTPKRSIDILRDVHAAKEQGKPYVIVFVGVNGVGKSTNLAKVAYWLLQHNISVMLAACDTFRSGAVEQLRTHARRLQIPIFEKGYEKDPAIVAREAIQEASRNSSDVVLVDTAGRMQDNEPLMRALSKLINLNNPDLVLFVGEALVGNDAVDQLSKFNQKLADLSTVPNARLIDGILLTKFDTIDDKVGAALSMVYISGAPVMFVGCGQSYTDLKKLNVKSIVKTLLK

SEQ ID NO: 204 - protein, 621 aa, Elaeis guineensis
MLEQLLIFTRGGLILWTCGNALKGSPIDALIRSCLLEERSAETFFSYDAPAGGAAYTLKWAFHNDLGLVFVAVYQRFLHLLYVDDLLAAVRREFSQIYDPKRTAYDEFDEIFRQLQKEAEARAEEMRKSKQSNRAPLVAGKKQGAGAGQRAGSQGNAKQKGGKGSSGKDDGDGELGKGRGLSNGRENGIKEPSRAPSVVVKGKENGAPVSGAFDVNKLQKLRPKGGKKIDTGSGKASKVEPKKTVKKNRVWDDSPSDSRLDFTDPADEKGDEVVDVGKADHGESMMDKEEIVSSESESEEDEEVETTKPGTKKKGWFSSMFQSIAGNAVLEKADLKPALKALKDRLMTKNVAEEIAEKLCESVAASLEGKKLGSFTRVSSTVQTAMEEALLRILTPKRSIDILRDVHAAKEQGKPYVIVFVGVNGVGKSTNLAKVAYWLLQHDISVMMAACDTFRSGAVEQLRTHARRLQIPIFEKGYEKDPAIVAREAIQEASHNNSDVVLVDTAGRMQDNEPLMRALSKLINLNNPDLVLFVGEALVGNDAVDQLSKFNQKLADLSTVPNARLIDGILLTKFDTIDDKVGAALSMVYISGAPVMFVGCGQSYTDLKKLNVKSIVKTLLK

SEQ ID NO: 205 - protein, 628 aa, Elaeis guineensis
MLEQLLIFTRGGLILWTYRELGNALKGSPVDALIRSCLLEERSAETSFSYDAPVGGAAYTLKWAFHNDLGLVFVAVYQRILHLLYVDDLLAAVRREFSQIYDPKRTAYDEFDEIFRQLQKEAEARAEEMRKSKQSNRALPVAGKKQGPGQRAGSQGNGKQKGAKVCSGKDDGDGESGEGRGLSKGSSNGQENGIKESSRAPSVVVKGKEDGTPEVGAFDVNKLQKLRSKGGKKSDAGGGGGKASKAELKKIVKKNRVWDDSPSKSRLDFTDPGDEKGDNIADVVTADQGESMMDKEEIVSSESESEEDEELECAKSGTKKKGWFSSMFQSIAGNAVLERSDLTPALKALKDRLMTKNVAEEIAEKLCESVAASLEGKKLGSFTRVSSTVQTAMEEALLRILTPKRSIDILRDVHAAKEQGKPYVIVFVGVNGVGKSTNLAKVAYWLLQHNISVMLAACDTFRSGAVEQLRTHARRLQIPIFEKGYEKDPAIVARESIQEASRNSSDVVLVDTAGRMQDNEPLMRALSKLINLNNPDLVLFVGEALVGNDAVDQLSKFNQKLADLSTVPNARLIDGILLTKFDTIDDKVGAALSMVYISGAPVMFVGCGQSYTDLKKLNVKSIVKTLLK

SEQ ID NO: 206 - protein, 622 aa, Phoenix dactylifera
MLEQLLIFTRGGLILWTCGNALKGSPIDTLIRSCLLEERSAETSFSYDAPAGGAAYTLKWAFHNDLDLVFVAVYQRILHLLYVDDLLAAVRREFSQIYDPKRTAYDEFDEIFRQLQKEAEARAEEMRKSKQSNRASLVAGKKQGAGAGQRAGGQGNAKQKGGKAGSGKDDDDDGESGRGRGLSNGRENGIKEPSRARSVVVKGKDNGAPEVGAFDVNKLQRLRPKGGKKTDTGGWRASKAEPKKIVKKNRVWDDSPSDSRLDFTDPVDEKGDEIVDVGKTDHGESMMDKEEIVSSDSESEEDEEVESAKPGTEKKGWFSSMFQSIAGKAVLEKADLKPALKALKDRLMTKNVAEEIAEKLCESVAASLEGKKLGSFTRVSSTVQTAMEEALLRILTPKRSIDILRDVHAAKEQGKPYVIVFVGVNGVGKSTNLAKVAYWLVQHNVSVMMAACDTFRSGAVEQLRTHARRLQVPIFEKGYERDPAIVAREAIQEASRNNSDVVLVDTAGRMQDNEPLMRALSKLINLNNPDLVLFVGEALVGNDAVDQLSKFNQKLADLSTVPNARLIDGILLTKFDTIDDKVGAALSMVYISGAPVMFVGCGQSYTDLKKLNVKSIVKTLLK

SEQ ID NO: 207 - protein, 563 aa, Musa acuminata
MLDQLLIFTRGGLILWELGSSLKGSPIDALIRSCLLEERSADAAFHYDAPGAAGGAAYTLKWVFDNDLGLVFVAVYQRIFHLLYVDDLLAAVRREFSRIHDPSRTSYDDFNETFRQLQKEAEARAEEMRKSKQAARSDGDSGKGRWLANVGAFDVNKLQKLRSKGGKKTDTGGVGSKATKAEPKKNVKKNRVWDDSPSESRLDFTNPVDERGEEPLEVVEADRGESMMDKEEIVSSESESEEDEEVENEKPCTKKKGWFSSMFQSIAGNAVLEKSDLKPALKALKDRLMTKNVAEEIAEKLCESVAASLEGKKLGSFTRVSSTVQTAMEEALLRILTPKRSIDILRDVHVAKEQGRPYVVVFVGVNGVGKSTNLAKVAYWLLQHEVNVMLAACDTFRSGAVEQLRTHARRLQIPIFEKGYEKDPAIVAKEAIQEAKSNNSDVVLVDTAGRMQDNEPLMRALSKLINLNNPDLVLFVGEALVGNDAVDQLTKFNQKLADLSTISNARLIDGILLTKFDTIDDKVGAALSMVYVSGAPVMFVGCGQSYTDLKKLNVKSIVKTLLK

SEQ ID NO: 208 - protein, 627 aa, Ananas comosus
MLEQLLIFTRGGLILWSSCRGLGNALKGSPIDALIRSCLLEERSAETSFAHDAYTLKWAFHNELGLVFVAVYQRILHLLYVDDLLAAVRREFAEIYDPKRTSYDDFDETFRQLQKEAEARAEEMKKSKQAGRAPAVPGKKQGAGGAAQRDAKQKGSGAGGGGSGKDDGDGDGDSGKGRWLANGNGNGQEKGARERSHAPPGSVVVKGKENGGPQAGAFDVNKLQKLRSKGGKKSDNTKPASKGGEPKKIVKKNRVWDDSPSESRLDFTDPVDERGEGIVEAVAADQGESMMDKEEDLSSESEAEEEDEEVEGAKPGAKKKGWFTSMFQSIAGNAIIEKSDLQPALKALKDRLMTKNVAEEIAEKLCESVAASLEGKKLGSFTRISSTVQTAMEEALLRILTPKRSIDILREVHAAKEHGKPYVIVFVGVNGVGKSTNLAKVAYWLLQHNISVMLAACDTFRSGAVEQLRTHARRLQIPIFEKGYEKDPAVVAREAIQEASRNKSDVVLVDTAGRMQDNEPLMRALSKLINLNSPDLVLFVGEALVGNDAVDQLSKFNQKLADLSTVPNARLIDGILLTKFDTIDDKVGAALSMVYISGAPVMFVGCGQSYTDLKKLNVKSIVKTLLK

SEQ ID NO: 209 - protein, 627 aa, Ananas comosus
MLEQLLIFTRGGLILWSSCRGLGNALKGSPIDALIRSCLLEERSAETSFAHDAYTLKWAFHNELGLVFVAVYQRILHLLYVDDLLAAVRREFAEIYDPKRTSYDDFDETFRQLQKEAEARAEEMKKSKQAGRAPAVPGKKQGAGGAAQRDAKQKGSGAGGGGSGKDDGDGDGDSGKGRWLANGNGNGQEKGARERSHAPPGSVVVKGKENGGPQAGAFDVNKLQKLRSKGGKKSDNTKPASKGGEPKKIVKKNRVWDDSPSESRLDFTDPVDERGEVIVEAVAADQGESMMDKEEDLSSESEAEEDDEEVEGAKPGAKKKGWFTSMFQSIAGNAIIEKSDLQPALKALKDRLMTKNVAEEIAEKLCESVAASLEGKKLGSFTRISSTVQTAMEEALLRILTPKRSIDILREVHAAKEHGKPYVIVFVGVNGVGKSTNLAKVAYWLLQHNISVMLAACDTFRSGAVEQLRTHARRLQIPIFEKGYEKDPAVVAREAIQEASRNKSDVVLVDTAGRMQDNEPLMRALSKLINLNSPDLVLFVGEALVGNDAVDQLSKFNQKLADLSTVPNARLIDGILLTKFDTIDDKVGAALSMVYISGAPVMFVGCGQSYTDLKKLNVKSIVKTLLK

SEQ ID NO: 210 - protein, 626 aa, Amorphophallus konjac
MLEQLLIFTRGGLILWTCKELGNALKGSPIDTLIRSCLLEERSADASYNYDAPTAGAAYTLKWTFHNELGLVFVAVYQRILHLLYVDDLLAAVKREFAEIYDPRRVAYDDFDEIFRQLQREAEARAEEMRKLKQAMSRAPVSGGVKKQGQINGHKAGSQGNGKQKSSDGSGKDDSDGDSRKADGVANGNHHGRQNQSKGSRRAAGVVKTEEKSSDGAFDVNKLQKMRSKGAKKTNTVVVGKGTNVEPKKITKKNRVWDDSPSESRLDFTDPVDERGEGNTEIVAADQGESMMDKEEDVSSDSDSEVDEAPESTKTNSKKGWFTSVFQSISGNAVLEKSDLQPALKALKDRLMTKNVAEEIAEKLCESVAASLEGKKLGSFTRISSTVQAAMEEALLRILTPKRSIDILRDVHAAKEQSKPYVIVFIGVNGVGKSTNLAKVAYWLLQHKLNVMMAACDTFRSGAVEQLRTHARRLQIPIFEKGYEKDPAIVAKEAIQEASRNKSDVVLVDTAGRMQDNEPLMRALSKLINLNKPDLVLFVGEALVGNDAVDQLTKFNQKLADLSMTPNARLIDGILLTKFDTIDDKVGAALSMVYISGAPVMFVGCGQSYTDLKKLNVKSIVKTLLK

SEQ ID NO: 211 - protein, 607 aa, Phoenix dactylifera
MLEQLLIFTRGGLILWTCGNALKGSPIDTLIRSCLLEERSAETSFSYDAPAGGAAYTLKWAFHNDLDLVFVAVYQRILHLLYVDDLLAAVRREFSQIYDPKRTAYDEFDEIFRQLQKEAEARAEEMRKSKQSNRASLVAGKKQGAGAGQRAGGQGNAKQKGGKAGSGKDDDDDGESGRGRGLSNGRENGIKEPSRARSVVVKGKDNGAPEVGAFDVNKLQRLRPKGGKKTDTGGWRASKAEPKKIVKKNRVWDDSPSDSRLDFTDPVDEKGDEIVDVGKTDHGESMMDKEEIVSSDSESEEDEEVESAKPGTEKKGWFSSMFQSIAGKAVLEKADLKPALKALKDRLMTKNVAEEIAEKLCESVAASLEGKKLGSFTRVSSTVQTAMEEALLRILTPKRSIDILRDVHAAKEQGKPYVIVFVGVNGVGKSTNLAKVAYWLVQHNVSVMMAACDTFRSGAVEQLRTHARRLQVPIFEKGYERDPAIVAREAIQEASRNNSDVVLVDTAGRMQDNEPLMRALSKLINLNNPDLVLFVGEALVGNDAVDQLSKFNQKLADLSTVPNARLIDGILLTKFDTIDDKVGAALSMVYISGAPVMFVGCGASYST

SEQ ID NO: 212 - protein, 471 aa, Musa acuminata
MRWENLLLLTPYHIMKPYSPELQNGSSRTSLQNTPRIVLLLTATLFLLTIIPLYLFPLLATSFAWRNLSSPPSSPSPSLSSSSSSPSSSSRDMSRDAMAGVTMAKSSCDIFRGEWVPNPNAPYYTNETCWAIHEHQNCMKFGRPDTEFLKWRWKPNDCDLPIFNPAQFLELVRGKSLAFVGDSVGRNQMQSLICLLLRVTYAVDASVTEDEKFRRYHFPTHNFTVASFWSPFLVRAHEADPNGPTLTGLFNLHLDQVDTNWTTQMTPFDYVIVSAGHWFFRPTMFFEADQLVGCHYCLHPNVTDLTMYYSYRRAFRAALRAFNDLPGFRGTVFLRTFAPSHFENGEWNKGGNCVRQRPFRSNETRMDGYNLEMYMAQLEEYRAAEGEGKEKGVRFRLLDTTEAMLLRPDGHPGRFGHRPDENVTLYNDCVHWCLPGPIDNWNDFLLHMLKNEGGRSAAGRRSRNDRKSTIK

SEQ ID NO: 213 - protein, 444 aa, Musa acuminata
MKANSCPELQNGSRTSLQNTSRIVLLLTATLLLLTIIPLYLFPLLATSLAWRSLSDSSSSSSSSSSSGDMARDSIAGLGVAQHSCDIFRGEWVPNPNAPYYTNESCWAIHDHQNCMMFGRPDTGFMKWRWKPTHCELPVFNPAQFLELVRGKSLAFVGDSVGRNQMQSLICLLHRVTYVVDASLTQDEKFRRYHFPTHNFTVASFWSPFLVRAHEADPNGPTHTGLFNLYLDEPDTNWTTKMTEFDYVIVSAGHWFFRPAMFFEGGQLVGCHYCLDPNVTDLTMYYSYRRAFRAAFGVFNSLEGFRGTVFLRTFAPSHFENGEWDKGGNCVRQQPFRSDETRLDGINLEMYMTQVEEFREAEMEGREKGVRFRLLDTTDAMLLRPDGHPSRYGHRPHENVTMYNDCVHWCLPGPIDTWNDFLLHMLKNEGGRARSRNARKSTIK

SEQ ID NO: 214 - protein, 444 aa, Musa acuminata
MKANSCPELQNGSRTSLQNTSRIVLLLTATLLLLTIIPLYLFPLLATSLAWRSLSDSSSSSSSSSSSGDMARDSIAGLGVAQHSCDIFRGEWVPNPNAPYYTNESCWAIHDHQNCMMFGRPDTGFMKWRWKPTHCELPVFNPAQFLELVRGKSLAFVGDSVGRNQMQSLICLLHRVTYVVDASLTQDEKFRRYHFPTHNFTVASFWSPFLVRAHEADPNGPTHTGLFNLYLDEPDTNWTTKMTEFDYVIVSAGHWFFRPAMFYEGGQLVGCHYCLAPNVTDLTMYYSYRRAFRAAFGVFNSLEGFRGTVFLRTFAPSHFENGEWDKGGNCVRQQPFRSDETRLDGINLEMYMTQVEEFREAEREGREKGVRFRLLDTTDAMLLRPDGHPSRYGHLPHENVTMYNDCVHWCLPGPIDTWNDFLLHMLKNEGGRARSRNARKSTIK

SEQ ID NO: 215 - protein, 444 aa, Musa acuminata
MKANSCPELQNGSRTSLQNTSRIVLLLTATLLLLTIIPLYLFPLLATSLAWRSLSDSSSSSSSSSSSGDMARDSIAGLGVAQHSCDIFRGEWVPNPNAPYYTNESCWAIHDHQNCMMFGRPDTGFMKWRWKPTHCELPVFNPAQFLELVRGKSLAFVGDSVGRNQMQSLICLLHRVTYVVDASLTQDEKFRRYHFPTHNFTVASFWSPFLVRAHEADPNGPTHTGLFNLYLDEPDTNWTTKMTEFDYVIVSAGHWFFRPAMFFEGGQLVGCHYCLDPNVTDLTMYYSYRRAFRAAFRVFNSLEGFRGTVFLRTYAPSHFENGEWDKGGNCVRQQPFRSDETRLDGINLEMYMTQVEEFREAEMEGREKGVRFRLLDTTDAMLLRPDGHPSRYGHRPHENVTMYNDCVHWCLPGPIDTWNDFLLHMLKNDGGRARSRNARKSTIK

SEQ ID NO: 216 - protein, 400 aa, Musa acuminata
MARLGGEATLTSRLLFFFLVSTAVMGGSATVETRRSVLGNGLGRTPPMGWNSWNHFHCNINEQLIRETADALVHTGLAGLGYRYVNIDDCWGEANRDYQGNLVAKRSTFPSGIKSLADYVHAKGLKLGIYSDAGSQTCSRTMPGSLGYEQHDATTFASWGVDYLKYDNCNNPGTRPRERYAKMSYALRNSGRNIFFSLCEWGDDNPATWASGIGNSWRTTGDIYDSWGSMTSRADENNRWASYAGPGGWNDPDMLEVGNGGMSTEEYRSHFSIWALVKAPLLIGCDVRTISGDALEILSNSEVIAVNQDYLGVQGKKVFGGGSEEVWAGRLSGGKVAVVLWNRGSSRATITARWSDIGLSSSTAVSVRDLWARATIGSVRGQLAATVAPHACKMYVLTPR

SEQ ID NO: 217 - protein, 406 aa, Musa acuminata
MARVAGEATMTSLLLLLLLLPTAATGGRVTKGWESAVETRRSVLDNGLGTTPPMGWNSWNHFHCDINEQLIRETADALVSTGLAELGYQYVNIDDCWGENYRDSQGNLVAKQSTFPSGINSLADYVHGKGLKLGIYSDAGTQTCSKTMPGSLGYEDQDAQTFASWGVDYLKYDNCNNPGTSPRERYSKMSSALQNSGRDIFFSLCEWGVDDPATWASSIGHSWRTTGDIFDSWDSMTSRADENDKWASYAKPGGWNDPDMLEVGNGGMTTEEYRSHFSIWALAKAPLLIGCDVRSISEDALEILSNSEVIAVNQDSLGVQGKKVVWGGGTEVWAGPLSGGTVAVVLWNRGSSPATITAEWSDIGLSSSTVVNARDLWAHSDTASVQGELTATVDSHACKMYVLTPQ

SEQ ID NO: 218 - protein, 406 aa, Musa acuminata
MARVAGEATMTSLLLLLLLLPTAATGGRVTKGWESAVERRRSVLDNGLGMTPPMGWNSWNHFHCDINEQLIRETADALVSTGLAEVGYQYVNIDDCWGENYRDSQGNLVAKQSTFPSGINSLADYVHGKGLKLGIYSDAGTQTCSKTMPGSLGYEDQDAQTFASWGVDYLKYDNCNNPGTNPRERYSKMSSALQNSGRDIFFSLCEWGVDDPATWASSIGHSWRTTGDIFDSWDSMTSRADENDKWASYAKPGGWNDPDMLEVGNGGMTTEEYRSHFSIWALAKAPLLIGCDVRSISEDALEILSNSEVIAVNQDSLGVQGKKVVWGGGTEVWAGPLSGGTVAVVLWNRGSSPATITAEWSDIGLSSSTVVNARDLWAHSDTASVQGELTATVDSHACKMYVLTPQ

SEQ ID NO: 219 - protein, 514 aa, Musa acuminata
MRKESLALLTTLLLLLLLLPTTESKLSRDDFPPGFIFGAGTSAYQVEGAAAKDGRTPSLWDTYTHAGGMLDNSTGDVASDQYHKYKEDVKLMADTGLDSYRFSISWSRLIPNGRGAINLKGLAYYNNLIDELLKYGIKPHVTIYHLDLPQALEDEYGGWLSQKIVEDFTAFADVCFREFGDRVSQWTTIVEPNIIGMASYDNGVFPPNRCSKPFGLLNCTVGDSTTEPYIATHNLLLSHASVVSLYRTKYQAIQNGRIGLNVYSFWCYPLTNSRLDFQATQRSLDFLIGWIISPLVFGDYPKIMKKIVRSRLPSFTEEQSEQVKGSFDFIGLNHYQSIWVKDNSNASKTAPRDFNADLFAKFSFSKNDTPSGQLIPADVPIDPDGLPHMLEYIRDAYGNPPVYIEENGYGYGTNDTIYDVERVNYLSAFISSMLDGIRKGANVKGYYVWSFLDVFEFLAGFQSRFGLYYVDFKDENLRRQPKLSALWYSDFLKKKKTGTNINRMGLHERSHSQQ

SEQ ID NO: 220 - protein, 515 aa, Musa acuminata
MRKESLALLTTLLLLLLLLLPSTESKLSRDDFPPGFIFGAGTSAYQVEGAAAKDGRTPSLWDTYTHAGRMLDNSTGDVASDQYHKYKEDVKLMADTGLDSYRFSISWSRLIPNGRGAINLKGLAYYNNLIDELLKYGIKPHVTIYHLDFPQALEDEYGGWLSQKIVEDFTAFADVCFREFGDRVSQWTTIVEPNIIGMASYDNGVFPPNRCSKPFGLLNCTVGDSTTEPYIATHNLLLSHASVVSLYRTKYQAIQNGRIGLNVYSFWCYPMTNSRLDFQATQRSLDFLIGWIISPLVFGDYPKIMKKIVRSRLPSFTEEQSEQVKGSFDFIGLNHYQSIWVKDNSNASKTAPRDFNADLFAKFSFSKNDTPSGQLIPADVPIDPDGLQHMLEYIRDAYGNPPVYIEENGYGYGTNDTIYDVERVNYLSAFISSMLDGIRKGANVKGYYVWSFLDVFEFLAGFQSRFGLYYVDFKDENLRRQPKLSALWYSDFLKKKKTGTNINRMGLHERSHSQQ

SEQ ID NO: 221 - protein, 390 aa, Zea mays
MGTNDRAVISLVLLVCIASRSSLGAAETDVEQKRLSVPLMFVFGDSLVDVGNNNFLPPPAPRAASPYGIDFHAGTAGAVSGRFTNGYNLADLVARRLGFKMSPPAYLSLTPVSKFDLFTCRIGANYASGGSGILNTTGNGTLTLQKQITLFSKTQARMSWARCKLRSMVSRSLFLVSAGGNDFSAFSEMGMGEQDAPAYISSMVSTYVQHIDALYKLGARRLGILDVPAIGCTPGSRVPMANGGCNDAANSMAQNFNRLLRLEVAKAVASSMPGMKYSIASTYNFVTDLMNSHLVAGLRVVDRACCGSGKLNAAVMCAQPNTTYCSDRDDYMFWDMLHPTQATNERGVVAIFYGPQEYADPINFAQLAAATANDDDDINTAMTAGVYAAI

SEQ ID NO: 222 - protein, 557 aa, Hordeum vulgare
MQTTERMALTSHLLAVLLGIAVPLLFSPRAEGGEVGVCYGRMAGNLPDPTSVVQLIKRNGITMVRIYDTNPTVLAALANTDIKVTVELTNEELPLVAADENDFAFRWVQSNVKAYYPATLINGVTIGNEVFKEAPQLNSQLVPAMKKVHAALDRLGLADAVKVTTPIAFDALMTSFPPSKGAFRDDIALSVMSPMVDFLKQTRSYLMVNIYPYLAYLSTPDMSIDYLLFRPNAGVHDRNSGQTYYSLLDAQLDAVYYAMDKLPSSSLRGMRKLTSLDEDVLVTCGEIHHPSKGHRGVGTLANAQAFTDGLLSKVLGGGNSDPLATSAVGTPHRPNADLSVYIFELFNENNKPEDEQDFGLFYPNEQPVYPVDFVHGGAGTGESYCVAKATAGDAALQAALDYACGHGADCGAIQPGKPCYEPNTKLAHASYAFNDYYQKNGRASSACDFGGAGTIVNQAPSGRCDASSSWCVANSAVGAERLQRALDYACGHGADCTDIQPGARCFNPDTKVAHASFAFNDYYQRHGRAAGTCDFAGAGTIVRQAPKIGNCVLPSRA

SEQ ID NO: 223 - protein, 563 aa, Aegilops tauschii
MTRLLIVLLGAALPLLFSLAEGGEVGVCYGRVATDLPDPASVVQLLKKNSITMVRIYDTDPTVLRSLANTNIKVTVELTNEELPLAAADQNNFALRWVQSNVKAYYPATLINGVTIGNEVFKEASHLNSQLVPAMKNVQAALAKLGLADAVKVTTPIAFDALKTSFPPSAGAFKDDIALSVMSPMVDFLQQTGSYLMVNFYPYLAYLDTPGMSINYLLFRPNNGVPDTVSGQTYFSLFDAELDAVYYAMEKLPSSSMHVGGMRKLTAGGGSLDVHQGEHGHPNKGHKGVGTPQNAQDFMAGLTLQVLQGNSATAAANGHDPLAASAVRGTPHRPNADLNVYIFALFNENNKPEDEQDFGLFYPNQQPVYPNPIDFVHGGTIGGPLQASYCVANAAVGDVALQAALDYACGNGADCSAIQSGKPCYEPNTKLAHASYAFNDYYQKNGRVRSACDFSGAGTIVNQAPSGACDPSPSWCVANAAVGDTRLQAALDYACGRGGADCTDIQPGARCFDPDTKVAHASFAFNSYYQRRGRATGTCDFAGAGTIVRQAPKIGNCVLPSRA

SEQ ID NO: 224 - protein, 230 aa, Aegilops tauschii
MAALTGAALLLASLLALAAITSGNTEGDILYSQRQAWKDPNNVLQSWDPTLVNPCTWFHVTCNNVNSVIRVDLGNAGLSGALVPGLGRMVNLQYLELFGNNISGPIPATLGNLTRLVSLDLYDNRLTGAIPASLGNIETLRFLRLHGNKLAGGIPASLGRLKKLQALELQENMLSGTVPLEVLSLVLVGDLTELNVAKNSLAGTVKSSKPRVATVIQDTLKTTRLHAEQH

SEQ ID NO: 225 - protein, 233 aa, Triticum aestivum
MAALTGAALLLASLLALAAIASGNTEGDILYSQRLAWKDPNNVLQSWDPTLVNPCTWFHVTCNNVNNVNSVIRVDLGNAGLSGALVPGLGRMVNLQYLELFGNNISGPIPATLGNLTRLVSLDLYDNHLTGAIPASLGNIGTLRFLRLHGNKFAGGIPSSLGRLTKLQTLELQENMLTGTVPLEVLSLVLLGDLTELNVAKNSLAGTVKSSKPRVATVIQDTLKTTRLHAEQH

SEQ ID NO: 226 - protein, 224 aa, Pseudoroegneria spicata
MAARTGAALLLASLLALAAIASSNTEGDILYSQRQVWSDPNNVLQSWDPTLVNPCTWFHVTCNNINSVIRVDLGNAGLSGALVPELGQMVNLQYLELFGNNISGPIPATLGNLTRLVSLDLYENHLTGEIPTSLGNIRTLRFLRLHGNKLAGGIPASLGRLTKLQTLELQENMLTGTVPLEVLSLVLVGDLTELNVAKNSLAGTVKSSKPRVATVIQDTLKTTR

SEQ ID NO: 227 - protein, 225 aa, Triticum urartu
MAALTGAALLLASLLALAAIASGNTEGDILYSQRLAWKDPNNVLQSWDPTLVNPCTWFHVTCNNVNSVIRVDLGNAGLSGALVPGLGRMVNLQYLELFGNNISGPIPATLGNLTRLVSLDLYDNRLTGAIPASLGNIGTLRFLRLHGNKLAGGILSSLGRLTKLQTLELQENMLTGTVPLEVLSLVLLGDLTELNVAKNSLAGTVKSSKPRGRDAYICDLQLLTD

SEQ ID NO: 228 - protein, 224 aa, Hordeum vulgare
MAALSGAALVLAGLLALAAIASGNTEGDILYRQRQEWKDINNVLQSWDPTLVNPCTWFHVTCNNDNSVIRVDLGNASLSGSLVPELGQMVNLQYLELFGNNISGPIPATLGNLTRLVSLDLYNNRLTGMIPASLGNIGTLRFLRLNGNKLAGGIPASLGNLTKLQTLELQENMLTGMVPLDVLSLVLFGDLTELNVAKNSLAGTVKSSKPRVATIIQDTLKTTR

SEQ ID NO: 229 - protein, 224 aa, Hordeum vulgare
MAALSGAALVLAGLLALAAIASGNTEGDILYRQRQELKDINNVLTSWDPTLVNPCTWFHVTCNSDNSVVRVDLGNASLSGSLVPELGQMVNLQYLELFGNNISGPIPATLGNLTRLVSLDLYNNRLTGMIPASLGNIGTLRFLRLNGNKLTGGIPASLGNLTKLQTLELQENMLTGMVPLDFLSLVLFGDLTELNVAKNSLSGTVKSSKPRVATIIQDTLKTTR

SEQ ID NO: 230 - protein, 224 aa, Aegilops tauschii
MEAQTGAALLLACLLALATIASSNTEGDILYSQRQVWKDPNNVLTSWDPTLVNPCTWFHVTCNNVNSVIRVDLGNAGISGTLIPQLGQLKNLQYLELYANNMSGPIPTTLGNLTRLVSLDLYDNHLTGVIPSSLGAVGRLRFLRLHGNKLAGVIPASLGRLTKLVELELQENMLTGTVPLEVLSLVLVGDLTELNVAKNNLAGTIKSSKPRVATVIQDTLKTTL

SEQ ID NO: 231 - protein, 207 aa, Secale cereale
AAIASSNTEGDILYSQRQAWKDTNNVLQSWDPTLVNPCTWFHVTCNNVNSVVRVDLGNAGLSGALVPELGQLKNLQYLELFGNNISGPIPATLGNLTRLVSLDLHQNRLTGAIPASLGSIGTLRFLRLHGNKLAGVIPASLGNLTKLQTLELQENMLTGTVPLEVLSLVLVGDLTELNVAKNSLAGTVKSSKPRVATIIQDTLKTTR

SEQ ID NO: 232 - protein, 224 aa, Hordeum vulgare
MAAQTGAALLLAGLLALATIVSSNTEGDILYSQRQVWKDPNNVLTSWDPTLVNPCTWFHVTCNLDNSVIRVDLGNAGISGTLIPQLGQLKNLQYLELYANNMSGPIPTTLGNLTRLVTLDLYDNHFTGAIPSSLGAVGTLRFLRLHGNKLAGGIPTSLGRLTKLVELELQENMLTGVVPLEVLSLVLVGDLTELNVAKNDLAGTARSSKPRVATVIQDTLKTTS

SEQ ID NO: 233 - protein, 224 aa, Hordeum vulgare
MAAQTGAALLLAGLLALATIVSSNTEGDILYSQRQVWKDPNNVLTSWDPTLVNPCTWFHVTCNLDNSVIRVDLGNAGISGTLIPQLGQLKNLQYLELYANNMSGPIPTTLGNLTRLVTLDLYDNHFTGAIPSSLGAVGTLRFLRLHGNKLAGDIPTSLGRLTKLVELELQENMLTGVVPLEVLSLVLVGDLTELNVAKNNLAGTVRSSKPRVATVIQDTLKTTS

SEQ ID NO: 234 - protein, 224 aa, Triticum aestivum
MAAQTGAVLLLVGLLALATMASSNTEGDILYSQRQVWKDPNNVLTSWDPTLVNPCTWFHVTCNLDNSVTRVDLGNAGISGTLIPQLGQLKNLQYLELYGNNMSGPIPTTLGNLTRLVSLDLYDNHLTGVIPSSLGAVGTLRFLRLHGNKLAGSIPASLGRLTKLVELELQENMLSGTVPLEILSLVLVGDLTELNVAKNNLAGTVISSKPRVATVIHDTLKTTS

SEQ ID NO: 235 - protein, 97 aa, Secale cereale
MKSSTLVAILVLQTVMVMGILSRSLATNDNFPKCCNNCNSWSGYQFCDDVGPRCRRGCANCQVVQTSPVKTFRCGDGRPVFDGHGTPTPCPPPCKKH

SEQ ID NO: 236 - protein, 96 aa, Aegilops tauschii
MKSSTLVAILVLQTVMVMGILSQAAAKDNFPKCCDNCNSWSGYQFCEDVGPRCRRGCANCQVVQMSPVKTFRCGDGRPVYDGHDTPTPCPPPCKKH

SEQ ID NO: 237 - protein, 1359 aa, Oryza sativa
MWHLRGRSSVTAAAAAALHKPVAHLRLLLAVSAWSVPAAASNVAAASTTTRGGPSPSAGVAPRAMPSSSSSPPSAAEGTTAAAGGFRLTEPSFLESLMPKKEIGVDRFLAAHPEYDGRGALIAIFDSGVDPAAAGLQTTSDGKPKILDVIDCTGSGDVDTSKVVKADDDGSIVGASGTHLIINPSWKNPSQEWHVGCKLVYELFTDTLTSRLKKERKKKWDEHSQEAISEALKQLNEFEKKHSKSDDAKQKMAREDLQSRLEYLRKQAEGYDDRGPVIDIVAWHDGDVWRVAVDTQGLEGNKNCGKLADFVPLTNYRLERKFGIFSKLDACSFVANIYDDGNLVSIVTDCSPHATHVAGIAAAFHPDEPLLNGVAPGAQLISCKIGDTRLGSMETGTGLVRALIAAVEHKCDLINMSYGEPTLLPDYGRFIDLASEVVDKHRIIFISSAGNNGPALNTVGAPGGTSSSIIGVGAYVSPAMAAGAHCVVQAPAEGMEYTWSSRGPTADGDLGVSISAPGGAVAPVPTWTLQSRMLMNGTSMSSPSACGGVALLVSAMKAEGIPLSPYTVRKAIENTAASISDVPEEKLTTGHGLLQVDRAFEYAQQTKELPLVSYRISINQVGKPTSKLRGIYLRGSNTCRQTSEWTVQLDPKFHEDASNMEQLVPFEECLQLHSTDSSVIKIPEYIMVTNNGRTFNIVVNPVNISSGLHYYEVYGIDCKAPWRGPIFRVPITVIKPIALSGEPPALTLSNLSFKSGHIERRFINVPIGASWVEVTMRTSAFDTPRRFFLDTVQICPLKRPIKWEAVVTFSSPSLKNFSFPVEGGLTLELSIAQFWSSGIASHEPTCVDFEIVFHGISVDQKIIGLDGSEAPVRVVARSLLASERLVPVATLNKVKTPYRPVESNLCSLPPSRDRLPSGKQIIALTLTYKFKLEDGAEIKPRVPLLNNRIYDNKFESQYYRISDSNKCVYSSGDVYPNYVKLSKGEYTLQLYIRHDNVQLLEKLKQLVLFIERKLEKKDFIQLSFYSEPDGPTVGNGTFKSSILVPGEPEAFYVGPPSREKLPKNVLPGSVLVGSITYGVVSSFSKKDDQNQHAPASYSISYLIPPSKVDNDKEKGVSSGRKSISERLDDEVRDTKIKFLSGFNQETEDDKSSWTALVASLKSEYPKYTPLLAKILECIVQKATSDDKFSHQKEIIAAADEVVDSIDKEDLAKSLSLKPDPEDEEAQKNKKKMEETRDQLADALYQKGLALAEIESLKTDESTEASAKDVFEENYKELIKWVDAKTTKYGSLTVLRERRCGRLGTALKVLNDMIQDDSEQPKKRLYDLKIQLIEEIGWVHVSAYEKQWMHVRFPPSLPPF

SEQ ID NO: 238 - protein, 1295 aa, Oryza sativa
MPSSSSSPPSAAEGTTAAAGGFRLTEPSFLESLMPKKEIGVDRFLAAHPEYDGRGALIAIFDSGVDPAAAGLQTTSDGKPKILDVIDCTGSGDVDTSKVVKADDDGSIVGASGTHLTINPSWKNPSQEWHVGCKLVYELFTDTLTSRLKKERKKKWDEHNQEAISEALKQLNEFEKKHSKSDDAKQKMAREDLQSRLEYLRKQAEGYDDRGPVIDIVAWHDGDVWRVAVDTQGLEGNKNCGKLADFVPLTNYRLERKFGIFSKLDACSFVANIYDDGNLVSIVTDCSPHATHVAGIAAAFHPDEPLLNGVAPGAQLISCKIGDTRLGSMETGTGLVRALIAAVEHKCDLINMSYGEPTLLPDYGRFIDLASEVVDKHRIIFISSAGNNGPALNTVGAPGGTSSSIIGVGAYVSPAMAAGAHCVVQAPAEGMEYTWSSRGPTADGDLGVSISAPGGAVAPVPTWTLQSRMLMNGTSMSSPSACGGVALLVSAMKAEGIPLSPYTVRKAIENTAASISDVPEEKLTTGHGLLQVDRAFEYAQQAKELPLVSYRISINQVGKPTSKLRGIYLRGSNTCRQTSEWTVQLDPKFHEDASNMEQLVPFEECLQLHSTDSSVIKIPEYIMVTNNGRTFNIVVNPVNISSGLHYYEVYGIDCKAPWRGPIFRVPITVIKPIALSGEPPALTLSNLSFKSGHIERRFINVPIGASWVEVTMRTSAFDTPRRFFLDTVQICPLKRPIKWEAVVTFSSPSLKNFSFPVEGGLTLELSIAQFWSSGIASHEPTCVDFEIVFHGISVDQKIIGLDGSEAPVRVVARSLLASERLVPVATLNKVKTPYRPVESNLCSLPPSRDRLPSGKQIIALTLTYKFKLEDGAEIKPRVPLLNNRIYDNKFESQYYRISDSNKCVYSSGDVYPNYVKLSKGEYTLQLYIRHDNVQLLEKLKQLVLFIERKLEKKDFIQLSFYSEPDGPTVGNGTFKSSILVPGEPEAFYVGPPSREKLPKNVLPGSVLVGSITYGAVSSFSKKDDQNQHAPASYSISYLIPPSKVDNDKEKGVSSGRKSISERLDDEVRDTKIKFLSGFNQETEDDKSSWTALVASLKPEYPKYTPLLAKILECIVQKATSDDKFSHQKEIIAAADEVVDSIDKEDLAKSLSLKPDPEDEEAQKNKKKMEETRDQLADALYQKGLALAEIESLKTDESTEASAKDVFEENYKELIKWVDAKTTKYGSLTVLRERRCGRLGTALKVLNDMIQDDSEQPKKRLYDLKIQLIEEIGWVHVSAYEKQWMHVRFPPSLPPF

SEQ ID NO: 239 - protein, 1365 aa, Oryza sativa
MWHLRGSSATTAAALHKSVAHLRLLLAVSAWSGPGPLLPAAAAAAALAAVSTRRGGPGPSARAVAASAMPSSSPSTSPPSAKGTTAAAAPAGFHLTEPSFLESLMPKKEIGVDRFLAAHPEYDGRGALIAIFDSGVDPAAAGLQTTSDGKPKILDILDCTGSGDVDTSKVVKADDDGSIVGASGTRLIINPSWKNPSQEWHVGYKLVYELFTDSLTSRLKKERKKKWDEENQEAISEALKQLNEFEKKHRKSDDAKLKMAHEDLQNRLDYLRKQAEGYDDRGPVIDVVAWHDGDVWRVAVDTQGLESNQNCGKLADFVPLTNYRLERKFGIFSKLDACSFVANIYDDGNLVSIVTDCSPHATHVAGIAAAFHPDEPLLNGVAPGAQLISCKIGDTRLGSMETGTGLVRALIAAVEHKCDLINMSYGEATLLPDYGRFIDLASEVVDKHRIIFISSAGNNGPALNTVGAPGGTSSSIIGVGAYVSPAMAAGAHCVVQAPAEGMEYTWSSRGPAADGDLGVSISAPGGAVAPVPTWTLQSRMLMNGTSMSSPSACGGVALLVSAMKAEGIPLSPYIVRKAIENTAASISDVPEEKLTTGHGLLQVDRAFEYAQQAKELPPVSYRISINQVGKSIPKLRGIYLRGSNTCQQTSEWTVQLDPKFHEDASNMEQLVPFEECLQLHSTDSSVVKIPEYIMVTNNGRSFNIVVNPVNISSGLHYYEVYGIDCKAPWRGPIFRVPITVIKPIALLGEPPALTLSNLSFKSGHIERRFINVPIGASWVEVTMRTSAFDTPRRFFLDAVQICPLKRPIKWEAVVTFSSPSLKNFSFPVDGGLTLELSIAQFWSSGIASHEPTCVDFEIVFHGISIDQRVIGLDGSEAPVRIVARSLLASERLVPVATLNKVKTPYRPVECNLCSLPTSRDRLPSGKQIIALTLTYKFKLEDGAEIKPHVPLLNNRIYDNKFESQFYRISDSNKCVYSSGDVYPDYVKLSKGEYTLQLYIRHDNVQLLEKMKQLVIFIERKLEKKDCIQLSFYSEPDGPVVGNGTFKSSVLVPGEPEAFYVGPPSGEKLPKNVLPGSLLAGSITYGAVSSFNKKDDQTQHAPASYCISYLIPPSKVDNDKEKGVSAGRKSISERLDEEVRDTKIKFLSGFNQETEDDKSSWMELVASLKAEYPKYTPLLAKILECIVQKATDDKISHQKEIIAAADEVVDSIDKEDLAKSLSLKPDPEDDEAQKNKKNMEETRDQLADALYQKGLALAEIESLKTDESTEASAKDDFEETYKELIKWVDAKSTKYGSLTVLRERRCGRLGTALKVLNDMIQDDSEQAKKKLYDLKIQLVEEIGWAHVSAYEKQWMHVRFPPSLPPF

SEQ ID NO: 240 - protein, 1356 aa, Brachypodium distachyon
MLHGSCATAAAPLHKPVAHLRVFLRVSACATSASLPTVAAVSTRSPSPSPSTGVAATAMPSSSSSPTPTPPAEETTAAAIGFHLTEPSFLESLMPKKETGVDRFLAKHPEYDGRGALIAIFDSGVDPAAAGLQTTSDGKPKILDVIDCTGSGDVDTSKVVKADADGAIVGASGTRLVVNPLWKNPSEQWHIGCKLVYELFTDTLISRLKKERKKKWDEENQEAISGALSQLNEFEKKHSKPDDAKLKMAHEDLQNRLDCLRKQAEGYDDRGPVIDVVVWHDGDVWRVAVDTQGLEGDKNCGKLADFVPLTNYRHERKFGIFSKLDACSFVANVYDDGNLVSIVTDCSPHATHVAGIAAAFHPEQPLLNGVAPGAQLISCRIGDTRLGSMETGTGLVRALIAAVEHKCDLINMSYGEPTLLPDYGRFIDLVNEVVDKHRIIFISSAGNNGPALNTVGAPGGTSSSIIGVGAYVSPAMAAGAHCVVQPPSEGMEYTWSSRGPTADGDLGVSISAPGGAVAPVPTWTLQSRMLMNGTSMSSPSACGGVALLVSAMKAEGIPLSPYTVRKAIENTAASISDVPEEKLTTGHGLLQVDRAFEYARQAKKLPLVSYRISVNQVGKSIPRLRGIYLRGSNACQQTSEWTVQLDPKFHEDASNLEQLVPFEECLQLHSTDSSVVNIPEYILLTNNGRSFNIVVNPANISSGLHYYEVYGTDCRAPWRGPIFRVPITVIKPIALSGEPPVLTLSKLYFKSGHIERRFINVPIGASWVEVTMRTSDFDTPRRFFLDTVQISPLKRPIKWEAVVTFSSPSLKNFSFPVEGGLTLELSIAQFWSSGIASHEPTCVDFEIVFHGISVDQKVIALDGSESPVRIVARSLLASEKLVPVATLNKIKIPYRPVDCNFCPLPTTRDRLPSGKQIIALTLTYKFKLEDGAEVKPHLPLLNNRIYDNKFESQFYRISDSNKCIYSSGDVYPSYVKLLKGEYTLQLYIRHENVQFLEKLKQLVLFIERKLEKKDFIQLSFYSEPDGPVIGNGTFKSSILVPGEPEAFYVGPPSGEKFPKSAPPGAVLVGSITYGIVSSFNKNNEQNQHAPASYSILCPIPPSKVDDSKEKGGSIGMKKSISERLNEEVRDTKIKFLSSIKQESEDQKSAWAELVASLKSEYPKYTPLLAKILECVLQEAPSDDKISHHKEVIVAADEVQDSIDKEQLAKILSLKPDPEEEESQITKKKMEETRDQLADALYQKGLALAEIESLKPDESTETSAKDAFEENYKELIKWVDAKSAKYGTLTVLRERRCGRFGTALKVLNDMIQDESGQPKKKLYDLKIQLIEEIGWAHVSAYEKQWMHVRFPPSLPPF

SEQ ID NO: 241 - protein, 1364 aa, Brachypodium distachyon
MLHGSCATAAAPLHKPVAHLRVFLRVSACATSASLPTVAAVSTRSPSPSPSTGVAATAMPSSSSSPTPTPPAEETTAAAIGFHLTEPSFLESLMPKKETGVDRFLAKHPEYDGRGALIAIFDSGVDPAAAGLQTTSDGKPKILDVIDCTGSGDVDTSKVVKADADGAIVGASGTRLVVNPLWKNPSEQWHIGCKLVYELFTDTLISRLKKERKKKWDEENQEAISGALSQLNEFEKKHSKPDDAKLKMAHEDLQNRLDCLRKQAEGYDDRGPVIDVVVWHDGDVWRVAVDTQGLEGDKNCGKLADFVPLTNYRHERKFGIFSKLDACSFVANVYDDGNLVSIVTDCSPHATHVAGIAAAFHPEQPLLNGVAPGAQLISCRIGDTRLGSMETGTGLVRALIAAVEHKCDLINMSYGEPTLLPDYGRFIDLVNEVVDKHRIIFISSAGNNGPALNTVGAPGGTSSSIIGVGAYVSPAMAAGAHCVVQPPSEGMEYTWSSRGPTADGDLGVSISAPGGAVAPVPTWTLQSRMLMNGTSMSSPSACGGVALLVSAMKAEGIPLSPYTVRKAIENTAASISDVPEEKLTTGHGLLQVDRAFEYARQAKKLPLVSYRISVNQVGKSIPRLRGIYLRGSNACQQTSEWTVQLDPKFHEDASNLEQLVPFEECLQLHSTDSSVVNIPEYILLTNNGRSFNIVVNPANISSGLHYYEVYGTDCRAPWRGPIFRVPITVIKPIALSGEPPVLTLSKLYFKSGHIERRFINVPIGASWVEVTMRTSDFDTPRRFFLDTVQISPLKRPIKWEAVVTFSSPSLKNFSFPVEGGLTLELSIAQFWSSGIASHEPTCVDFEIVFHGISVDQKVIALDGSESPVRIVARSLLASEKLVPVATLNKIKIPYRPVDCNFCPLPTTRDRLPSGKQIIALTLTYKFKLEDGAEVKPHLPLLNNRIYDNKFESQFYRISDSNKCIYSSGDVYPSYVKLLKGEYTLQLYIRHENVQFLEKLKQLVLFIERKLEKKDFIQLSFYSEPDGPVIGNGTFKSSILVPGEPEAFYVGPPSGEKFPKSAPPGAVLVGSITYGIVSSFNKNNEQNQHAPASYSILCPIPPSKVDDSKEKGGSIGMKKSISERLNEEVRDTKIKFLSSIKQESEDQKSAWAELVASLKSEYPKYTPLLAKILECVLQEAPSDDKISHHKEVIVAADEVQDSIDKEQLAKILSLKPDPEEEESQITKKKMEETRDQLADALYQKGLALAEIESLKVHYLPSHLPDESTETSAKDAFEENYKELIKWVDAKSAKYGTLTVLRERRCGRFGTALKVLNDMIQDESGQPKKKLYDLKIQLIEEIGWAHVSAYEKQWMHVRFPPSLPPF

SEQ ID NO: 242 - protein, 1351 aa, Setaria italica
MWPSLHKPVAHAHLRLLLAVSACSGPLHFGTTTSAVAAAVTTRGPSPSSGVAATAMPSSSSSPPPPAEETTAAASPAGGFRLTEPSFLESLMPKKEIGVDRFLAAHPEYDGRGALIAIFDSGVDPAAAGLQTTSDGKPKILDVIDCTGSGDVDTSKVVKADADGAIVGASGARLVVNSSWKNPSQEWHVGCKLIYELFTYTLTSRLKKERKKKWDEENQEAISDALKQLNEFEKKHTKPDDATLKKAHEDLQSRLDYLRKQAEGYDDKGPVIDIVAWHDGDVWRVAVDTQTLEGKNNGGKLADFVPLTNYRLERKYAIFSKLDACSFVANIYDDGNLVSIVTDCSPHATHVAGIAAAFHPDEPLLNGVAPGAQLISCKIGDTRLGSMETGTGLVRALIAAVEHKCDLINMSYGEPTILPDYGRFIDLSNEVVDKHRIIFISSAGNSGPALNTVGAPGGTSTTIIGVGAYVSPAMAAGAHCVVQPPAEGMEYTWSSRGPTADGDLGVSISAPGGAVAPVPTWTLQSRMLMNGTSMASPSACGGVALLVSGMKAEGIPLSPYSVRKAIENTAACISNAPEEKLTTGNGLLQVDRAFEYTQHAKKLPLVSYRISITQVGKSIPKLRGIYLRGSNACHQTSEWTVQLDPKFHEDASNLEQLVPFEECLQLHSTDTSVIQIPEYILVTNNGRSFNIVVNPANISNGLHYYEVYGIDYKAPWRGPIFRVPITVIKPITLLGEPPLLSITNLSFRSGHIERRFINVPFGASWAEVTMRTSAFDTPRKFFLDTVQICPLKRPIKWEAAVSFSSPSSKNFSFPVEGGLTLELSIAQFWSSGIASHEPTCVDFEIVFHGICIDQKVIALDGSESPLRIVARSLLASEKLAPVATLNKIKTPYRPVECNLSSLPTDRDRLPSGKQVIALTLTYKFKLEDSAEVKPHVPLLNNRIYDNKFESQFYRISDSNKRVYSSGDVYPSYVKLSKGEYTLQLYIRHENVQFLEKLKQLVLFIERKLDKKDFIPLSFYSEPDGPIVGSGTFRSTILVPGEPEAFYVSPPSREQLPKNAPPGAVLVGSITYGTVSTFNKKDDQKQHAPVSYNISYSIPPSKVNDDKEKGVSVGTKSISEQLVEEVRDTKIKFLSSLKQETEEDKSAWSELVASLKSEYPKYTPLLAKILECVLRKANDDKIGHEKEVITAADEVVDSIDKEELAKYLYLNSDPEDEEAQKFKKKLEETRDQFADALYQKGLALAEIESLKSDESIEASSKDIFEENYKELIKWVDAKSAKYGTLTVLRERRCGRPGTALKVLNDLIQNESEPKKKLYDLKIQLIEEMGWSHVSTYEKQWMQVRFPPTLPPF

SEQ ID NO: 243 - protein, 1353 aa, Sorghum bicolor
MWASLHKPVAHANLHLLIAVSACSGPLHFGTASAVAAALTTRRSSPSRGVAATAMPSSSPSPPPPAEETTASAAAPAPAGGFRLTEPSFLESLMPKKEIGVDRFLAAHPEYDGRGALIAIFDSGVDPAAAGLQTTSDGKPKILDVLDCTGSGDVDTSKVVKADADGAIVGASGARLVINSSWKNPSQEWHVGCKLIYELFTDTLISRLKKERKKKWDEENQEAISDALKQLNEFEKKHPKPDDTVLKKAHEDLQSRLDYLRKQAEGYDDKGPVIDIVTWNDGDVWRVAVDTQTLEGNNDGGKLADFVPLTNYRLERKYAIFSKLDACSFVANVYNDGNLVSIVTDCSPHATHVAGIAAAFHPDEPLLNGVAPGAQLISCKIGDTRLGSMETGTGLVRALIAAVEHKCDLINMSYGEPTLLPDYGRFIDLSNEVVDKHRIIFISSAGNNGPALNTVGAPGGTSTSIIGVGAYVSPAMAAGAHCVVQPPAKGMEYTWSSRGPTADGDLGVSISAPGGAVAPVPTWTLQSRMLMNGTSMASPSACGGVALLVSGMKAEGIPLSPYSVRKAIENTAASISNAPEEKLTTGNGLLQVDRAFEYAQQAKKLPLVSYRISINQVGKSIPKLRGIYLRGGNACRQTSEWTVQLDPKFHEGASNLEQLVPFEECLQLHSTDTSVVQIPEYILVTNNGRSFNIVVNPANISSGLHYFEVYGIDYKAPWRGPIFRVPITVIKPITLLGEPPLLSISNLSFQSGHIERRFINVPFGASWAEVTMRTSAFDTPRRFFLDTVQICPLKRPVKWEAVVTFSSPSSKNFSFPVEGGLTLELSIAQFWSSGIASHEPTCVDFEIVFHGISIDQKVTTLDGESPLLIVARSLLASEKLVPVATLNKIRMPYRPVECNLSSLPTDRDRLPSGKQIIALTLTYKFKLEDSAEIKPHVPLLNNRIYDNKFESQFYRISDSNKRIYSTGDVYPSYVKLSKGEYTLQLYIRHENVQVLEKLKELVLFIERKLDKKDFVPLSFYSEPDGPIVGSGTFKSTVLVPGEPESFYVGPPSREKLPKNASPGAVLVGSITYGTVSTFNKKGEQNHHAPVSYSISYTILPSKVDDDKEKGVSVGTKSVSEQLNEEVRDTKIKFLSSVKQQTEEDKSAWSELVASLKSEYPKYTPLLSKILECVLQKGTDDDKISHEKEVIAAADEVVGSIDKEELAKYLSLNSDPEDEEAQKFKKKMEETRDQLVDALYQKCLALAEIESLKSDESIETSAKDIFEENYKELIKWVDAKSAKYGTLTVLREKRCGRPGTALKVLNDLIQNESEPKKKLYDLKIQLIEEMGWTHVSTYEKQWMQVRFPPSLPPF

SEQ ID NO: 244 - protein, 1298 aa, Brachypodium distachyon
MPSSSSSPTPTPPAEETTAAAIGFHLTEPSFLESLMPKKETGVDRFLAKHPEYDGRGALIAIFDSGVDPAAAGLQTTSDGKPKILDVIDCTGSGDVDTSKVVKADADGAIVGASGTRLVVNPLWKNPSEQWHIGCKLVYELFTDTLISRLKKERKKKWDEENQEAISGALSQLNEFEKKHSKPDDAKLKMAHEDLQNRLDCLRKQAEGYDDRGPVIDVVVWHDGDVWRVAVDTQGLEGDKNCGKLADFVPLTNYRHERKFGIFSKLDACSFVANVYDDGNLVSIVTDCSPHATHVAGIAAAFHPEQPLLNGVAPGAQLISCRIGDTRLGSMETGTGLVRALIAAVEHKCDLINMSYGEPTLLPDYGRFIDLVNEVVDKHRIIFISSAGNNGPALNTVGAPGGTSSSIIGVGAYVSPAMAAGAHCVVQPPSEGMEYTWSSRGPTADGDLGVSISAPGGAVAPVPTWTLQSRMLMNGTSMSSPSACGGVALLVSAMKAEGIPLSPYTVRKAIENTAASISDVPEEKLTTGHGLLQVDRAFEYARQAKKLPLVSYRISVNQVGKSIPRLRGIYLRGSNACQQTSEWTVQLDPKFHEDASNLEQLVPFEECLQLHSTDSSVVNIPEYILLTNNGRSFNIVVNPANISSGLHYYEVYGTDCRAPWRGPIFRVPITVIKPIALSGEPPVLTLSKLYFKSGHIERRFINVPIGASWVEVTMRTSDFDTPRRFFLDTVQISPLKRPIKWEAVVTFSSPSLKNFSFPVEGGLTLELSIAQFWSSGIASHEPTCVDFEIVFHGISVDQKVIALDGSESPVRIVARSLLASEKLVPVATLNKIKIPYRPVDCNFCPLPTTRDRLPSGKQIIALTLTYKFKLEDGAEVKPHLPLLNNRIYDNKFESQFYRISDSNKCIYSSGDVYPSYVKLQKGEYTLQLYIRHENVQFLEKLKQLVLFIERKLEKKDFIQLSFYSEPDGPVIGNGTFKSSILVPGEPEAFYVGPPSGEKFPKSAPPGAVLVGSITYGIVSSFNKNNEQNQHAPASYSILCPIPPSKVDDSKEKGGSIGMKKSISERLNEEVRDTKIKFLSSIKQESEDQKSAWAELVASLKSEYPKYTPLLAKILECVLQEAPSDDKISHHKEVIVAADEVQDSIDKEQLAKILSLKPDPEEEESQITKKKMEETRDQLADALYQKGLALAEIESLKPDESTETSAKDAFEENYKELIKWVDAKSAKYGTLTVLRERRFGRFGTALKVLNDMIQDESGQPKKKLYDLKIQLIEEIGWAHVSAYEKQWMHVRFPPSLPPF

SEQ ID NO: 245 - protein, 1297 aa, Secale cereale
MPSSSSAPTTPPPAEETTAAAASGFRLTEPSFLESLMPKKETGVDRFLAEHPEYDGRGSLIAIFDSGVDPSAAGLQKTSDGKPKILDVIDCTGSGDVDTSKVVKADADGAIVGASGARLSVNPSWKNPSQEWRVGCKLVYELFTDTLISRLKKERKKKWDEENQEAISGALNQLNEFEKKHSKPDDAKLKKAQEDLQNRLDCLRKQADGYDDRGPVIDVVVWNDGDVWRVAVDTQGLEDKKDCGKLADFVPLTNYRIERKFGIFSKLDACSFVANVYDDGNLVSIVTDCSPHATHVAGIAAAFHPEEPLLNGVAPGAQLISCRIGDTRLGSMETGTGLVRALIAAVEHKCDLINMSYGEPALLPDYGRFIDIVNEVVDKHRIIFISSAGNNGPALNTVGAPGGTSSSIIGIGAYVSPAMAAGAHCVVQPPSEGMEYTWSSRGPTADGDLGVSISAPGGAVAPVPTWTLQSRMLMNGTSMSSPSACGGVALLVSAMKAEGIPVSPYTVRKAIENTASSISDVPEEKLTTGHGLLQVDRAYEYARQAKKLPLVSYRISISQVGKSIPKLRGIYLRGSNSCQQTSEWTVQLNPKFHDDASNLEQLVPFEECLQLHSTDSSVINIPEYILLTNNGRSFNIVVNPVNISSGLHYYEVYGMDCRAPWRGPIFRVPITIIKPIALSGEPPVLSLSKLYFKSGHIERRFINVPIGASWAEVTMRTSAFDTPRRFFLDTVQMCPLKRPIKWESVVTFSSPSIKNFSFPVEGGLTLELSIAQFWSSGNASHEPTCVDFEIVFHGISIDQKVIALDGSESPMRIVARSLLASERLVPVATLNKIKIPYRPVDSNFCPLPTSRDRLPSGKQIIALTLTYKFKLEDGAEVKPHLPLLNNRIYDNKFESQFYRISDSNKCVYSSGDVYPSYVKLPKGEYTLQLYIRHENVQILEKLKQLVLFIERKLEKKDCIQLSFYSEPDGPIIGNATFKSSVLVPGEPEAFYVGPPSREKLPKGAPPGSVLVGSITYGIVSSFNKKDEQHAPASYSILCIIPPSKVDDTKEKGVSVETKKSVSERLNDEVRDTKIKFLSGLKQDNEDTKSAWTELVASLKSEYPKYTPLLAKILECVLQESTSDDKISHHKEVIVAADEVVDSIDKEQLAKLLSLKPDPEDEESQKTKKKMEETRDQLADALYQKGLALAEIESLKPDESTEASAKDVFEENYKELIKWVDAKSTKYGTLTVLRERRCGRCGTALKVLNDMIQEDSEQPKKKLYDLKIQLIEEIGWAHVSAYEKQWMHVRFPPSLPPF

SEQ ID NO: 246 - protein, 1286 aa, Avena sativa
MPSSNSAPTTPADETTAAATSGFRLTEPSFLESLMPKKETGVDRFLAAHPEYDGRGALIAIFDSGVDPAAAGLQTTSDGKPKILDVIDCTGSGDVDTSNVVKADADGAIVGASGTRLIVNSSWKNPSQEWRVGYKLVYELFTDTLISRLKKERKKKWDEENQEAISGALNQLNEFEKKHGKPDDAKLKKAKEDLQDRLDCLKKQSDGYDDKGPVIDVVVWHDGDAWRVAVDTQGLEGNKDCGKLADFVPLTNYRLERKFGIFSKLDACSFVANVYDDGNLVSIVTDCSPHATHVAGIAAAFHPEEPLLNGVAPGAQLISCRIGDTRLGSMETGTGLVRALIAAVEHKCDLINMSYGEPTLLPDYGRFIDLVNEVVDKHRIIFISSAGNNGPALNTVGAPGGTSSSIIGIGAYVSPAMAAGAHCVVQPPSEGMEYTWSSRGPTADGDLGVSISAPGGAVAPVPTWTLQSRMLMNGTSMSSPSACGGVALLVSAMKAEGIPLSPYTVRKAIENTAASISDVPEEKLTTGHGLLQVDRAFEYARQAKKLPLVSYRISINQVGKSIPKLRGIYLRGSNACQQTSEWTVQLNPKFHEDASNLEQLVPFEECLQLHSTDSSVVSIPEYILLTNNGRSFNIVVNPVNISSGLHYYEVYGMDCRAPWRGPIFRVPITVIKPIALSGEPPVLSLSKLYFKSGHIERRFINVPIGASWAEVTMRTSAFDTPRRFFLDTVQMCPLKRPIKWEAVVTFSSPSLKNFSFSVEGGLTLELSIAQFWSSGNASHEPTCVDFEIVFHGISVDQKVIVLDGSESPMRIVARSLLASERLVPVASLNKIRIPYRPVECNFCPLPTSRDRLPSGKQIIALTLTYKIKLEEGAEIKPHLPLLNNRIYDNKFESQFYRISDSNKSVYSSGDVYPSYVKLPKGDYTLQLYIRHENVQFLEKLKQLVLFIERKLEKKDFIQLSFYSEPDGPIVGNATFKSSILVPGEPEAFYVGPPSTEKLPKSSPPGSVLVGSITYGVVSSFNKKEEQNQHAPASYSILCVIPPSKVDDNKEKGVSVGTEKSVSERLNDEVRDTKIKFLSSLKKEKEDKSAWTELVASLKSEYPKYTPLFAKILECVLQESTSDDKISHHKEVIVAADEVVDSIDKEELAKLLSLKPDPEDEESQKTKKKMEETRDQLADALYQKGLALAEIESLKPDESTEASAKDVFEENYKELIKWVDAKTTKYGTLTVLRERRCGRCGTALKVINDMIQEDSEQPKKKLYDLKLQLIEEIGWAHVSAYERQWMH

SEQ ID NO: 247 - protein, 1352 aa, Zea mays
MWATLHKPVAHANLRLLLTVSAFSGPLHLGTASAVAAAVTTRRSSSSRGVAATAMPSSSPPPLPPAEETTASAAALAPEGGFSLTEPSFLESLMPKKEIGVDRFLAAHPEYDGRSALIAIFDSGVDPAAAGLQTTSDGKPKILDVLDCTGSGDVDTSKVVKADADGAIVGASGARLVINPSWKNPSQEWHVGCKLIYELFTDTLTSRLKKERKKKWDEENQESISDALKQLNEFEKKHPKPDDTMLKKAHEDMQSRLDYLRKQAEGYDDKGPVIDIVTWNDGDVWRVAVDTQTLEGNNDGGKLADFVPLTNYRLERKYAIFSKLDACSFVANVYNDGNLVSIVTDCSPHATHVAGIAAAFHPDEPLLNGVAPGAQLISCKIGDTRLGSMETGTGLVRALIAAVEHKCDLINMSYGEPTLLPDYGRFIDLSNEVVDKHRIIFISSAGNNGPALNTVGAPGGTSTSIIGVGAYVSPAMAAGAHCVVQPPAKGMEYTWSSRGPTADGDLGVSISAPGGAVAPVPTWTLQSRMLMNGTSMSSPSACGGVALLVSGMKAEGIPLSPYSVRKAIENTAASISNAPEEKLTTGNGLLQVDRAFEYAQQAKKLPLVSYRISINQVGKSVPKLRGIYLRGGNACCQTSEWTVQLDPKFHEGASNLEQLVPFEECLQLHSTDTSVVQIPEYILVTNNGRSFNIVVNPANISSGLHYFEVYGIDYKAPWRGPIFRVPITVIKPIALLGEPPLLSISNLRFQSGHIERRFINVPFGASWAEVTMRTSAFDTPRRFFLDTVQICPLKRPVKWEAVVTFSSPSSKNFSFPVEGGLTLELSIAQFWSSGIASHEPTCVDFEIVLHGISIDQKVSTLDGESPLLIVARSLLASEKLVPVGTLNKIRIPYRPVECNLSSLPTDRDKLPSGKQIIALTLTYKFKLEDNAEIKPHVPLLNNRIYDNKFESQFYRISDSNKRIYSSGDVYPSYVRLSKGEYTLQLYIRHENVQFLEKLKELVLFIERKLDKKDFVPLMFYSQPDGPIVGSGTFKSTVLVPGEPEAFYVGPPSSEKLPKNAPPGAVLVGSITYGTVSTFNKKDEQNHRAPVSYSISYTILPSKVDDKEKGVLVGTKSIPEQLDEEVRDTKIKFLSSVKQLTEEDKSAWSELVVSLKSEYPKYTPLLSKILQCVLQKGTDGDKISHEKEVIAAADEVVGSIDKEELAKYLSLNSDPEDEEAQKFKKKIEETRDQLADALYQKCLALAEIESLKSDESIEVSAKDIFEENYKELIKWVDVKSAKYGTSTVLREKRCGRPGTALKILNDLIQNESEPKKKLYDLKIQLIEEMGWNHVSTYEKQWMQVRFPPCLPPF

SEQ ID NO: 248 - protein, 1296 aa, Setaria italica
MPSSSSSPPPPAEETTAAASPAGGFRLTEPSFLESLMPKKEIGVDRFLAAHPEYDGRGALIAIFDSGVDPAAAGLQTTSDGKPKILDVIDCTGSGDVDTSKVVKADADGAIVGASGARLVVNSSWKNPSQEWHVGCKLIYELFTYTLTSRLKKERKKKWDEENQEAISDALKQLNEFEKKHTKPDDATLKKAHEDLQSRLDYLRKQAEGYDDKGPVIDIVAWHDGDVWRVAVDTQTLEGKNNGGKLADFVPLTNYRLERKYAIFSKLDACSFVANIYDDGNLVSIVTDCSPHATHVAGIAAAFHPDEPLLNGVAPGAQLISCKIGDTRLGSMETGTGLVRALIAAVEHKCDLINMSYGEPTILPDYGRFIDLSNEVVDKHRIIFISSAGNSGPALNTVGAPGGTSTTIIGVGAYVSPAMAAGAHCVVQPPAEGMEYTWSSRGPTADGDLGVSISAPGGAVAPVPTWTLQSRMLMNGTSMASPSACGGVALLVSGMKAEGIPLSPYSVRKAIENTAACISNAPEEKLTTGNGLLQVDRAFEYTQHAKKLPLVSYRISITQVGKSIPKLRGIYLRGSNACHQTSEWTVQLDPKFHEDASNLEQLVPFEECLQLHSTDTSVIQIPEYILVTNNGRSFNIVVNPANISNGLHYYEVYGIDYKAPWRGPIFRVPITVIKPITLLGEPPLLSITNLSFRSGHIERRFINVPFGASWAEVTMRTSAFDTPRKFFLDTVQICPLKRPIKWEAAVSFSSPSSKNFSFPVEGGLTLELSIAQFWSSGIASHEPTCVDFEIVFHGICIDQKVIALDGSESPLRIVARSLLASEKLAPVATLNKIKTPYRPVECNLSSLPTDRDRLPSGKQVIALTLTYKFKLEDSAEVKPHVPLLNNRIYDNKFESQFYRISDSNKRVYSSGDVYPSYVKLSKGEYTLQLYIRHENVQFLEKLKQLVLFIERKLDKKDFIPLSFYSEPDGPIVGSGTFRSTILVPGEPEAFYVSPPSREQLPKNAPPGAVLVGSITYGTVSTFNKKDDQKQHAPVSYNISYSIPPSKVNDDKEKGVSVGTKSISEQLVEEVRDTKIKFLSSLKQETEEDKSAWSELVASLKSEYPKYTPLLAKILECVLRKANDDKIGHEKEVITAADEVVDSIDKEELAKYLYLNSDPEDEEAQKFKKKLEETRDQFADALYQKGLALAEIESLKSDESIEASSKDIFEENYKELIKWVDAKSAKYGTLTVLRERRCGRPGTALKVLNDLIQNESEPKKKLYDLKIQLIEEMGWSHVSTYEKQWMQVRFPPTLPPF

SEQ ID NO: 249 - protein, 1299 aa, Sorghum bicolor
MPSSSPSPPPPAEETTASAAAPAPAGGFRLTEPSFLESLMPKKEIGVDRFLAAHPEYDGRGALIAIFDSGVDPAAAGLQTTSDGKPKILDVLDCTGSGDVDTSKVVKADADGAIVGASGARLVINSSWKNPSQEWHVGCKLIYELFTDTLISRLKKERKKKWDEENQEAISDALKQLNEFEKKHPKPDDTVLKKAHEDLQSRLDYLRKQAEGYDDKGPVIDIVTWNDGDVWRVAVDTQTLEGNNDGGKLADFVPLTNYRLERKYAIFSKLDACSFVANVYNDGNLVSIVTDCSPHATHVAGIAAAFHPDEPLLNGVAPGAQLISCKIGDTRLGSMETGTGLVRALIAAVEHKCDLINMSYGEPTLLPDYGRFIDLSNEVVDKHRIIFISSAGNNGPALNTVGAPGGTSTSIIGVGAYVSPAMAAGAHCVVQPPAKGMEYTWSSRGPTADGDLGVSISAPGGAVAPVPTWTLQSRMLMNGTSMASPSACGGVALLVSGMKAEGIPLSPYSVRKAIENTAASISNAPEEKLTTGNGLLQVDRAFEYAQQAKKLPLVSYRISINQVGKSIPKLRGIYLRGGNACRQTSEWTVQLDPKFHEGASNLEQLVPFEECLQLHSTDTSVVQIPEYILVTNNGRSFNIVVNPANISSGLHYFEVYGIDYKAPWRGPIFRVPITVIKPITLLGEPPLLSISNLSFQSGHIERRFINVPFGASWAEVTMRTSAFDTPRRFFLDTVQICPLKRPVKWEAVVTFSSPSSKNFSFPVEGGLTLELSIAQFWSSGIASHEPTCVDFEIVFHGISIDQKVTTLDGESPLLIVARSLLASEKLVPVATLNKIRMPYRPVECNLSSLPTDRDRLPSGKQIIALTLTYKFKLEDSAEIKPHVPLLNNRIYDNKFESQFYRISDSNKRIYSTGDVYPSYVKLSKGEYTLQLYIRHENVQVLEKLKELVLFIERKLDKKDFVPLSFYSEPDGPIVGSGTFKSTVLVPGEPESFYVGPPSREKLPKNASPGAVLVGSITYGTVSTFNKKGEQNHHAPVSYSISYTILPSKVDDDKEKGVSVGTKSVSEQLNEEVRDTKIKFLSSVKQQTEEDKSAWSELVASLKSEYPKYTPLLSKILECVLQKGTDDDKISHEKEVIAAADEVVGSIDKEELAKYLSLNSDPEDEEAQKFKKKMEETRDQLVDALYQKCLALAEIESLKSDESIETSAKDIFEENYKELIKWVDAKSAKYGTLTVLREKRCGRPGTALKVLNDLIQNESEPKKKLYDLKIQLIEEMGWTHVSTYEKQWMQVRFPPSLPPF

SEQ ID NO: 250 - protein, 1311 aa, Zea mays
MWATLHKPVAHANLRLLLTVSAFSGPLHLGTASAVAAAVTTRRSSSSRGVAATAMPSSSPPPLPPAEETTASAAALAPEGGFSLTEPSFLESLMPKKEIGVDRFLAAHPEYDGRSALIAIFDSGVDPAAAGLQTTSDGKPKILDVLDCTGSGDVDTSKVVKADADGAIVGASGARLVINPSWKNPSQEWHVGCKLIYELFTDTLTSRLKKERKKKWDEENQESISDALKQLNEFEKKHPKPDDTMLKKAHEDMQSRLDYLRKQAEGYDDKGPVIDIVTWNDGDVWRVAVDTQTLEGNNDGGKLADFVPLTNYRLERKYAIFSKLDACSFVANVYNDGNLVSIVTDCSPHATHVAGIAAAFHPDEPLLNGVAPGAQLISCKIGDTRLGSMETGTGLVRALIAAVEHKCDLINMSYGEPTLLPDYGRFIDLSNEVVDKHRIIFISSAGNNGPALNTVGAPGGTSTSIIGVGAYVSPAMAAGAHCVVQPPAKGMEYTWSSRGPTADGDLGVSISAPGGAVAPVPTWTLQSRMLMNGTSMSSPSACGGVALLVSGMKAEGIPLSPYSVRKAIENTAASISNAPEEKLTTGNGLLQVDRAFEYAQQAKKLPLVSYRISINQVGKSVPKLRGIYLRGGNACCQTSEWTVQLDPKFHEGASNLEQLVPFEECLQLHSTDTSVVQIPEYILVTNNGRSFNIVVNPANISSGLHYFEVYGIDYKAPWRGPIFRVPITVIKPIALLGEPPLLSISNLRFQSGHIERRFINVPFGASWAEVTMRTSAFDTPRRFFLDTVQICPLKRPVKWEAVVTFSSPSSKNFSFPVEGGLTLELSIAQFWSSGIASHEPTCVDFEIVLHGISIDQKVSTLDGESPLLIVARSLLASEKLVPVGTLNKIRIPYRPVECNLSSLPTDRDKLPSGKQIIALTLTYKFKLEDNAEIKPHVPLLNNRIYDNKFESQFYRISDSNKRIYSSGDVYPSYVRLSKGEYTLQLYIRHENVQFLEKLKELVLFIERKLDKKDFVPLMFYSQPDGPIVGSGTFKSTVLVPGEPEAFYVGPPSSEKLPKNAPPGAVLVGSITYGTVSTFNKKDEQNHRAPVSYSISYTILPSKVDDKEKGVLVGTKSIPEQLDEEVRDTKIKFLSSVKQLTEEDKSAWSELVVSLKSEYPKYTPLLSKILQCVLQKGTDGDKISHEKEVIAAADEVVGSIDKEELAKYLSLNSDPEDEEAQKFKKKIEETRDQLADALYQKCLALAEIESLKSDESIEVSAKDIFEENYKELIKWVDVKSAKYGTSTVLREKRCGRPGTALKVWLLETLLNW

SEQ ID NO: 251 - protein, 332 aa, Musa acuminata
MVSSSSFFFLFLLCSVLFLSDEATSLPELPNLTTLSFEEGYTQLFGDSNLLLHRDGRAVHLALDQRTGAGFASQDLYLHGFFSASIKLPSDYAAGVVVAFYMSNGDVFEKSHDELDFEFLGNIRGREWRVQTNVYGNGSTAVGREERYQLWFDPTEDYHQYSILWSHERIIFYIDNIPIREVVRTQAMGGDFPSKPMSLYATIWDGSTWATSGGRYKVNYKLAPYVADFADLILHGCAVDPSDHKTACQRSDAVLYDAITMSADQRTAMAKFRKKHMTYSYCHDRIRYPTPPPECMFVGPESQNFLASGDAKFNYRHRRGRRYGRSSVDAVL

SEQ ID NO: 252 - protein, 333 aa, Musa acuminata
MASSSSFFFVLFFLLVSALFLETTALPELPNLTTLSFEEGYTQLFGDSNLMLHRDGMAVHLSLDQRTGAGFASQDLYLHGVFSASIKLPSDYAAGVVVAFYMSNGDVFEKTHDELDFEFLGNIRGREWRVQTNVYGNGSTAVGREERYGLWFDPTEDYHRYSILWSNRRIIFYIDNIPIREVVRSQAMGGDFPSKPMSLYATIWDGSNWATSGGRYKVNYKFAPYVAEFADLVLHGCAVDPSDRRRACQASDAELYDAITMSADQRTTMETLRKKHMTYSYCHDRIRYPAPPPECVLGPEAESFLASGEAKFNYRRRRSKHYGRSSVDAVLLA

SEQ ID NO: 253 - protein, 335 aa, Musa acuminata
MVSSSSFFFLFLLCSVLFLSDEATSLPELPNLTTLSFEEGYTQLFGDSNLLLHRDGRAVHLALDQRTALLGAGFASQDLYLHGFFSASIKLPSDYAAGVVVAFYMSNGDVFEKSHDELDFEFLGNIRGREWRVQTNVYGNGSTAVGREERYQLWFDPTEDYHQYSILWSHERIIFYIDNIPIREVVRTQAMGGDFPSKPMSLYATIWDGSTWATSGGRYKVNYKLAPYVADFADLILHGCAVDPSDHKTACQRSDAVLYDAITMSADQRTAMAKFRKKHMTYSYCHDRIRYPTPPPECMFVGPESQNFLASGDAKFNYRHRRGRRYGRSSVDAVL

SEQ ID NO: 254 - protein, 333 aa, Musa acuminata
MASSSSFFFVLFLLLVSALFLETTALPELPNLTTLSFEEGYTQLFGDSNLMLHRDGMAVHLSLDQRTGAGFASQDLYLHGVFSASIKLPSDYAAGVVVAFYMSNGDVFEKTHDELDFEFLGNIRGREWRVQTNVYGNGSTAVGREERYGLWFDPTEDYHRYSILWSNRRIIFYIDNIPIREVVRSQAMGGDFPSKPMSLYATIWDGSNWATSGGRYKVNYKFAPYVAEFADLVLHGCAVDPSDRRRACQASDAELYDAITMSADQRTTMETFRKKHMTYSYCHDRIRYPAPPPECVLGPEAESFLASGEAKFNYRRRRSKHYGRSSVAAVLLV

SEQ ID NO: 255 - protein, 340 aa, Musa acuminata
MASSSSSSSSSSALFFYYLLLLGSALFLTNEAIALPEVPNLTTLSFEEGYTQLFGDSNLILHLDGRTVHLSLDQRTGAGFASQGLYLHGFFSASIKLPADYAAGVVVAFYMSNGDVFEKTHDELDFEFLGNIRGREWRVQTNVYGNGSTAVGREERYGLWFDPTEDYHQYSILWSNERIIFYIDNTPIREVVRTQTMGGDFPSKPMSLYATIWDGSTWATSGGRYKVNYKFAPYVAEFTDLVLHGCVVDPSNHNRTCLESNAGVYNAMMISTDQRAAMERFRKKHMTYSYCHDRIRYLTPSPECSLGPETKSFLITGEARSSYHHHHGKRNGRSTVDVAL

SEQ ID NO: 256 - protein, 271 aa, Musa acuminata
MDLSGHEGEIPIPITSAYVGGHGQTNMRDTPPIHHPSNGPPPPPPPLPIATTEDHQRHHHATNSHSTKKGVAVRYRECLKNHAASIGGNATDGCGEFMPSGEEGSLEALKCSACGCHRNFHRKETEGESSCDCFHPLRGRKVMGQKGLLLSGSDAFGYGPACNGLIPRATPHSMIMPLGAIQTSESDEMEGVGGMMARPLMVKKRFRTKFTPEQKEKMLSFAEKVGWKLQKQEESVVQQFCQEIGVKRRVLKVWMHNNKHHLAKKNPLQLE

SEQ ID NO: 257 - protein, 277 aa, Elaeis guineensis
MDLSGHEGEIPIPITSTYVGGHGQNHGHTIIHDTPPLHHHHPPNGPPPPPPLSTATSEEHQHHPAIPYSTKKGVVVRYRECLKNHAASIGGTATDGCGEFMPSGEEGTLEALKCSACNCHRNFHRKDVEGESSSCDCFHHLKGRKMLGQKGLLISGPEAFGYAPAGNSLIPRPSPHHMIMPLGALQTSESDEMEGVGGGAMVRPPMVKKRFRTKFTPEQKEKMLSFAEKVGWRLQKQEESVVQQFCQEIGVKRRVLKVWMHNNKHNLAKKSPPLQLE

SEQ ID NO: 258 - protein, 514 aa, Musa acuminata
MRKESLALLATLVLLLPTAESNLSRDDFPPGFIFGAGTSAYQVEGAAAEDGRTPSIWDTYTRAGGMLDNSTGDVTSDQYHKYKEDVKLMVDTGLDSYRFSISWSRLLPNGRGAINPKGLAYYNNLIDELLRYGITPHVTIYHYDLPQVLEDEYEGWLSHKIVEDFTAFADVCFREFGDRVSQWTTIVEPNVIAIGSFDSAIFPPSRCSNPFGLFNCTVGDSTTEPYTAAHNFLLAHASVVSLYRTKYQAKQNGRIGLNVYSMWCYPSTNSTLDLQATQRLLDFFVGWIINPLVFGDYPKVMKKIVRSRLPSFTEEQSEQLKGSFDFIGLNHYSSIWVKDNSDASETAPRDFNADLFAKFAISKNETPGSQLVPTDIPFDPAGLQHLLEYIRDAYGNPPVYIEENGYGLGLNNTISDVKRANYLSGYIGSTLDGIRKGANVKGYYVWSFLDVFEFLSGFQSPFGLYHVDFKDENRRRQPKLSALWYSDFLKKKKKKKTSTNINMMGLHQRSHSQR

SEQ ID NO: 259 - protein, 390 aa, Zea mays
MGTNDRAVISLVLLVCIASRSSLGAAETDVEQKRSSVPLMFVFGDSLVDVGNNNFLPPPAPRAASPYGIDFPAGTPGAVSGRFTNGYNLADLVARRLGFKMSPPAYLSLTPLSKFDLFTCRIGANYASGGSGILNTTGNGTLTLQKQITLFSKTKARMSWGRCKLSSMVSRSLFLISAGGNDFSAFSEMGMGEQDAPAYISSMVSTYVQHIDALYKLGARRLGILDVPAIGCTPGSRVPMANGGCNDAANSMAQNFNKLLRLEVAKAVASSMPGMRYSIASTYNFVTDLMDSHLVAGLRVVDRACCGSGKLNAAVMCAQPNTTYCSDRDDYMFWDMLHPTQATNERGVVAIFYGPQEYADPINFAQLAAATANDDDDINTAMAAGVYAAI

SEQ ID NO: 260 - protein, 558 aa, Aegilops tauschii
MALTSHLLVVLLGIAVPLLFFSRAEGGEVGVCYGRMATNLPDPATVVQLLKKNSITMVRIYDTDPTVLRSLANTGIKVTVELTNEELPSAATDQNFADQWVQNNVKAYYPATLINGVTIGNEVFKEASQLNSQLVPAMTKVQAALARLGLADAVKVTTPIAFDALKMSFPPSEGAFRDDIALSVMSPMVNFLQETGSYLMMNIYPYLAYLSTPGMSIDYLLFRPNVGVVDKNSKQTYFSLLDAQLDAVYYAMEKLPSSSLRAGGMRKLTAGGGILEVKLGESHHPTRGHHGVGTRANAQAFTDGLMSKVRGGNSGTTSNKYNRLATSAVGTPHRPNADLDVYIFELFNEDNKPEDEQDFGLFYPNQQPVYQVDFVHGAGPVQPSYCTAKATAGDAALQAALDYACGHGADCSAIQPGKPCYEPNTKLAHASYAFNDYYQKNGRASGACDFGGAGTIVNQAPSGRCDLSPSWCVANAAVGAARLQNALDYACGHGADCTDIQPGARCFDPDTKVAHASFAFNDYYQRHNQAAGTCDFAGAGTIVRQAPKIGNCVLPSRA

SEQ ID NO: 261 - protein, 430 aa, Musa acuminata
MEIECLKEFPHPLMDRRPRKRPRLGWDVDPLTAAKAQIGILCGQEVNLKSLVPSGGASDHTCASQSAKDQERDASPPWRGDDKDGHYKFELGENLTSRYKIHSKMGEGTFGQVLECWDREREEMVAIKIVRGINKYREAAMIEINMLQQLGKYDKNASRCVQIRNWFDYRNHICIVFEKLGPSLYDFLRKNSYRSFPIDLVREFARQLLECVAFMHDMRLIHTDLKPENILLVSPEYIKVPDYKVSSRSPKQGSYFKRLPKSSAIKVIDFGSTTYDRHDNSYVVSTRHYWAPEVILGLGWSYPCDIWSVGCILVELCSGETLFQTHENLEHLAMMERVLGPLPSNMLRLAARDAERYVRRGHLNWPEGATSRESMKAVLKLPRLQNLVMQHSDHSAGDFIDLLQGLLRYDPADRLAANAALLHPFFTRNR

SEQ ID NO: 262 - protein, 432 aa, Platanus occidentalis
MEMECLTEFPHTHMDRRPRKRPRLAWDVPQAPKAQPGIFCGQEVGNLTSFAPSRAPSDHTSSLFVKGVARNGSPPWRDDDKDGHYIFALGENLTSRYRIHSKMGEGTFGQVLECWDRERKEMVAIKIVRGIKKYREAAMIEIEVLQQLGKHDKGGSRCVQIRNWFDYRNHICIVFEKLGPSLYDFLRKNNYRSFPIDLARELGRQLLECVAFMHDLHLIHTDLKPENILLVSPEYIKVPDYKVSSRSPKDGSYFKRLPKSSAIKVIDFGSTTYEHQDHSYIVSTRHYRAPEVILGLGWSYPCDIWSVGCILVELCSGEALFQTHENLEHLAMMERVLGPIPQHMLKRVDRHAEKYVRRGRLDWPEGATSRESIKAVLKLPRLQNLVMQHVDHSAGDLIDLLQGLIKYDPVDRLTAREALRHPFFTRDQHRRS

SEQ ID NO: 263 - DNA, 26 bp, Artificial Sequence
  Primer
gagagcacaaggtttaagagaatgga

SEQ ID NO: 264 - DNA, 24 bp, Artificial Sequence
  Primer
gcaagaggatttcagtggtcattc

SEQ ID NO: 265 - DNA, 24 bp, Artificial Sequence
  Primer
gttccgaatttgagaggatggaag

SEQ ID NO: 266 - DNA, 22 bp, Artificial Sequence
  Primer
tcatgcaggggagccaccaaac

SEQ ID NO: 267 - DNA, 31 bp, Artificial Sequence
  Primer
cggaattccgttagacttcgacgctgcaggc

SEQ ID NO: 268 - DNA, 32 bp, Artificial Sequence
  Primer
tcgactcgagccatgtcggacaagaactgcgg

SEQ ID NO: 269 - DNA, 35 bp, Artificial Sequence
  Primer
tttgagctctcagcagtacctgaaccacttattcg

SEQ ID NO: 270 - DNA, 34 bp, Artificial Sequence
  Primer
ttactcgagagcaaggtagtttaaggctgagagg

SEQ ID NO: 271 - DNA, 35 bp, Artificial Sequence
  Primer
aacgagctctcaaaccactgggactcagagaactg

SEQ ID NO: 272 - DNA, 20 bp, Artificial Sequence
  Primer
atggcggaagagcagcgatg

SEQ ID NO: 273 - DNA, 22 bp, Artificial Sequence
  Primer
tcgatttaaacctgtccgaaac

SEQ ID NO: 274 - DNA, 26 bp, Artificial Sequence
  Primer
atggggaggcaatcgtgctgctacaa

SEQ ID NO: 275 - DNA, 32 bp, Artificial Sequence
  Primer
tttgcggccgctctttgggtttgttcagatcg

SEQ ID NO: 276 - DNA, 32 bp, Artificial Sequence
  Primer
aaaactagtcaaagcaggagtagcaaacagtc

SEQ ID NO: 277 - DNA, 31 bp, Artificial Sequence
  Primer
tttgcggccgcttgggtttgttcagatcgga

SEQ ID NO: 278 - DNA, 33 bp, Artificial Sequence
  Primer
tttactagtgcaggagtagcaaacagtcatgag

SEQ ID NO: 279 - DNA, 31 bp, Artificial Sequence
  Primer
aaactcgagatggagagcagcagcatatgag

SEQ ID NO: 280 - DNA, 36 bp, Artificial Sequence
  Primer
tttgaattcctactatttgatcgtggacttcctgtc

SEQ ID NO: 281 - DNA, 20 bp, Artificial Sequence
  Primer
atggctagacttggaggtga

SEQ ID NO: 282 - DNA, 20 bp, Artificial Sequence
  Primer
ctaccgcggcgtcagaacgt

SEQ ID NO: 283 - DNA, 30 bp, Artificial Sequence
  Primer
aaactcgagaaaggagatgagggaagggag

SEQ ID NO: 284 - DNA, 31 bp, Artificial Sequence
  Primer
aaagagctcttggaggaatgttaccaccgag

SEQ ID NO: 285 - DNA, 28 bp, Artificial Sequence
  Primer
aaacccgggtaggaagcctgctgaagcc

SEQ ID NO: 286 - DNA, 31 bp, Artificial Sequence
  Primer
aaaggatcctcacatgagtcaccgttgagag

SEQ ID NO: 287 - DNA, 30 bp, Artificial Sequence
  Primer
aaagagctcctccaaagccaacaaacagag

SEQ ID NO: 288 - DNA, 31 bp, Artificial Sequence
  Primer
tttgaattctcatcatatggcggcatagacg

SEQ ID NO: 289 - DNA, 33 bp, Artificial Sequence
  Primer
aaagaattcctcctcaaggccatagctagctag

SEQ ID NO: 290 - DNA, 33 bp, Artificial Sequence
  Primer
tttggatccgtgacacgtaaccaggctataagc

SEQ ID NO: 291 - DNA, 32 bp, Artificial Sequence
  Primer
aaacccgggacagtgcattcaactaccttacg

SEQ ID NO: 292 - DNA, 29 bp, Artificial Sequence
  Primer
tttgaattccttccttcttccagcaatgg

SEQ ID NO: 293 - DNA, 30 bp, Artificial Sequence
  Primer
tttcccgggctctcccagcagtttcagaag

SEQ ID NO: 294 - DNA, 29 bp, Artificial Sequence
  Primer
tttgaattctgggaagagatttgctccac

SEQ ID NO: 295 - DNA, 31 bp, Artificial Sequence
  Primer
aaaggatccgcaacatcgatctcactgtctg

SEQ ID NO: 296 - DNA, 32 bp, Artificial Sequence
  Primer
ttagaattcagagatttgctccacaagttcag

SEQ ID NO: 297 - DNA, 34 bp, Artificial Sequence
  Primer
attggatcctcatctgagctctagcgatcaatgc

SEQ ID NO: 298 - DNA, 36 bp, Artificial Sequence
  Primer
aaagcggccgctcaaatcgataaacgtgagtgaatc

SEQ ID NO: 299 - DNA, 31 bp, Artificial Sequence
  Primer
tttggatcccgatgagcttagcagtagcagg

SEQ ID NO: 300 - DNA, 21 bp, Artificial Sequence
  Primer
atggctaagaccaacctccca

SEQ ID NO: 301 - DNA, 24 bp, Artificial Sequence
  Primer
tcagaaagaggatcgttcaagtgg

SEQ ID NO: 302 - DNA, 29 bp, Artificial Sequence
  Primer
aaactcgagcgatcatggagatcgaatgc

SEQ ID NO: 303 - DNA, 36 bp, Artificial Sequence
  Primer
tttgagctcttattagcgatttcttgtgaagaaagg

SEQ ID NO: 304 - DNA, 20 bp, Artificial Sequence
  Primer
atgagttcgctgcgagcttc

SEQ ID NO: 305 - DNA, 38 bp, Artificial Sequence
  Primer
gaccacgcgtatcgatgtcgactttttttttttttttt

SEQ ID NO: 306 - DNA, 20 bp, Musa acuminata
  5prime gRNA
tgtggataactcctacttgg

SEQ ID NO: 307 - DNA, 20 bp, Musa acuminata
  3prime gRNA
ttgcatccacgttacattct

SEQ ID NO: 308 - DNA, 1000 bp, Musa acuminata
  Upstream flanking region
tatctgtgttgaatgaagagagattgaatccgagaataatctcacattactaaacattgaaaatctggttaaaattttggattgatttgatgtttaatctaatatatgtaatttgaatcaattttttggttgtgtatgctgaatctaatcaacaatcttatgattcaaaatatgcctataattaatatgaaaattgatcaggacataaatgctaaatgatataatccttattcctataactagtcaatcattgatgcttgactcaaacttattgattacacatgctgactctgacacacacacttatgagtctacctactctttacaataatatatctataattaagagtcaacaaaactattctaatttaatattttcgatccaattcatactatttcatcttcatcatttattccattaaaaaaaggttaaattcatgatgataaacctaaatgattggtgtggtaccatcacactactgatgtgtcttttccaacaagacaaaagtaggcctgtatgagcacaaaagtcagagtgaattggaactttcattaaaataccataatagttgagaagttcttgtcaccaaacatgatcgattgtactataaaaagctaatagataaaaaaaaaaacatgcattaattaatgcttgttttacatgctccaatgacatctttgtcttcaacctagcaaaagcaaactactcatccattgacgaagaagccctgtgcgtaatcttggtgaagaagaaacttggaagagtcatgatggtagaaaccacgaaggctgcttctgcgtgctgtgtgagtgatgatattgttgttaccggaaccctattgtcggacgcaaatagggacccatggcttcgatgatatggttgagaagctgctccgtcgcagtcagacagagagggagggagagagacagggaagccatccaaagttgaagagaaaagtcatggcttatctggatcaatggcgtgtggataactcctact

SEQ ID NO: 309 - DNA, 1000 bp, Musa acuminata
  Downstream flanking region
atgtaacgtggatgcaatatttctcacactcaatcaactcatctgagcttatcttaggttgaagatttggatcatcatcttcctcgactttgttaggtcattgacttgtggaatgagcaagtgtgggatgattgcttactaagactgaaggatgtgtgatgtactcgattaacttaatagtttgattgaagaatatggagataagacacagagtgtgcttctaattcgattacatatttaatcgaatcgactcaaaatctattaatatggttttgttaacctatttatcattttaaataatttaacatatattaaataaatcagaatcttggtcaaatgtcaatgacatatgactcatgtcgtaaaattataacattaaaattgaatcaaattgggcctataaatttagattaagggcaagaatattggacttactaaagtttggataaaagcccaaaatttaatcctataaatttctcctctaacttaaacacattttattggtatagttatgtacgcatacttatctctaaatatcgaaagattatttatctctaaattataaaaaaaaatattttttatcgttgaacagtggttttgctacatgaactcgttttaaactcgattagaaggaatagatacttggaaagaaatccaatttaatgcagccaatatgcccaacccaaatgccacctcaggaggagcgtggaatctacatagacggcaagggtacagatactaaaggacaggccatgtttcatggagatcttgtcatcgtgtttacctcactacatctcaatccttataaaatgatttgatttgattaggtttctttttgaataataaaaaaatatctttacaatattttactaagatggcggtagttgattataaaaaaataatttatcgtttgcgtcgatacaacaccattatctcttttcaaggaatttgagcccgcgattcaaaatatttaatcttcgtagacatcaatctactataa

SEQ ID NO: 310 - DNA, 17 bp, Musa acuminata
  5prime gRNA after cut
tgtggataactcctact

SEQ ID NO: 311 - DNA, 17 bp, Musa acuminata
  3prime gRNA after cut
atgtaacgtggatgcaa

SEQ ID NO: 312 - DNA, 3345 bp, Artificial sequence
  Complete repair construct
tatctgtgttgaatgaagagagattgaatccgagaataatctcacattactaaacattgaaaatctggttaaaattttggattgatttgatgtttaatctaatatatgtaatttgaatcaattttttggttgtgtatgctgaatctaatcaacaatcttatgattcaaaatatgcctataattaatatgaaaattgatcaggacataaatgctaaatgatataatccttattcctataactagtcaatcattgatgcttgactcaaacttattgattacacatgctgactctgacacacacacttatgagtctacctactctttacaataatatatctataattaagagtcaacaaaactattctaatttaatattttcgatccaattcatactatttcatcttcatcatttattccattaaaaaaaggttaaattcatgatgataaacctaaatgattggtgtggtaccatcacactactgatgtgtcttttccaacaagacaaaagtaggcctgtatgagcacaaaagtcagagtgaattggaactttcattaaaataccataatagttgagaagttcttgtcaccaaacatgatcgattgtactataaaaagctaatagataaaaaaaaaaacatgcattaattaatgcttgttttacatgctccaatgacatctttgtcttcaacctagcaaaagcaaactactcatccattgacgaagaagccctgtgcgtaatcttggtgaagaagaaacttggaagagtcatgatggtagaaaccacgaaggctgcttctgcgtgctgtgtgagtgatgatattgttgttaccggaaccctattgtcggacgcaaatagggacccatggcttcgatgatatggttgagaagctgctccgtcgcagtcagacagagagggagggagagagacagggaagccatccaaagttgaagagaaaagtcatggcttatctggatcaatggcgtgtggataactcctacttggcttccctataaggaagcagatggcgatgccatgttttggtagatacactaagaatgagttcgctgcgagcttcctcctccaaacttgtgtgggtggccgctttggtcgtgtcactcatggccttgtgtgaggcgcagctcacgcctaactactacggcaagacctgcccacaggtgctgccaaccgtcaagaaagccaccggtacggcgatcgctcgagagcatcgcatggccgcgtccctcctccgactccatttccatgactgctttgttcagggttgtgacgcgtccatcttgctgaacgatgcggcgggcatcgtgagcgagaagaacgcacgtcaaaacttcagatctgcgagaggatacgaagtgatcgacggcataaagtcggccgtggggaaggtgtgtccgggcgtcgtgtcttgtgctgatatccttgccatcgttgcacgagactcctccgtatacgtgggtgggccttcatggaaggtgaagctcggaagaagagactccaccaccgccagcaaagatctggcagagcaaaacctgccaatagccttcgacgacctcgacacgctcacctccgtgttcgcgcggcaaggactcagcctcaaagacatggtcgtcctctcaggatcgcacaccatcgggctggctcagtgcgccaccttccgggggaggatatacaacgagacgaacatcgacgcgggattcgccaggatgcggcagcgccggtgccctccgaccgccggcaacggtgacacagacctggccccgcttgacctggtcacccccggctccttcgacaacaactactacaagaacctgctgggaaagaagggcctgctgcactcggaccagctcctcttcaacggcgggtctaccgacgccacggtggtggcgtacagcaaggaccaggcggctttcttcgccgacttcgcggctgccatggtgaagatgggcgacatcagccccctcactggctccgccggggaggtcaggaaggtctgcagcgtggtgaactaagcgctgttatcctctctctctctctctctctctctcactctgtgtgtgtgtgtgtgtgtgtgtgtgtacgtcagatgcgtccaaatgggatggactgtgtcttatacgttgtcggtgtttggattgcctcgctatcgacgtttcggtcgatgcaatgcaaatggtttcttcgcgaagcccatatgtttgctatcaataatgaagtccacgttgatctaaagaacacgtaatctattgattgtattgtattcgattaattaatctattttattcaacacatagtcaaattgctcacacttgcccatattttatgtagaatgtaacgtggatgcaatatttctcacactcaatcaactcatctgagcttatcttaggttgaagatttggatcatcatcttcctcgactttgttaggtcattgacttgtggaatgagcaagtgtgggatgattgcttactaagactgaaggatgtgtgatgtactcgattaacttaatagtttgattgaagaatatggagataagacacagagtgtgcttctaattcgattacatatttaatcgaatcgactcaaaatctattaatatggttttgttaacctatttatcattttaaataatttaacatatattaaataaatcagaatcttggtcaaatgtcaatgacatatgactcatgtcgtaaaattataacattaaaattgaatcaaattgggcctataaatttagattaagggcaagaatattggacttactaaagtttggataaaagcccaaaatttaatcctataaatttctcctctaacttaaacacattttattggtatagttatgtacgcatacttatctctaaatatcgaaagattatttatctctaaattataaaaaaaaatattttttatcgttgaacagtggttttgctacatgaactcgttttaaactcgattagaaggaatagatacttggaaagaaatccaatttaatgcagccaatatgcccaacccaaatgccacctcaggaggagcgtggaatctacatagacggcaagggtacagatactaaaggacaggccatgtttcatggagatcttgtcatcgtgtttacctcactacatctcaatccttataaaatgatttgatttgattaggtttctttttgaataataaaaaaatatctttacaatattttactaagatggcggtagttgattataaaaaaataatttatcgtttgcgtcgatacaacaccattatctcttttcaaggaatttgagcccgcgattcaaaatatttaatcttcgtagacatcaatctactataa

SEQ ID NO: 313 - DNA, 972 bp, Musa acuminata
  Cloned gene CDS
atgagttcgctgcgagcttcctcctccaaacttgtgtgggtggccgctttggtcgtgtcactcatggccttgtgtgaggcgcagctcacgcctaactactacggcaagacctgcccacaggtgctgccaaccgtcaagaaagccaccggtacggcgatcgctcgagagcatcgcatggccgcgtccctcctccgactccatttccatgactgctttgttcagggttgtgacgcgtccatcttgctgaacgatgcggcgggcatcgtgagcgagaagaacgcacgtcaaaacttcagatctgcgagaggatacgaagtgatcgacggcataaagtcggccgtggggaaggtgtgtccgggcgtcgtgtcttgtgctgatatccttgccatcgttgcacgagactcctccgtatacgtgggtgggccttcatggaaggtgaagctcggaagaagagactccaccaccgccagcaaagatctggcagagcaaaacctgccaatagccttcgacgacctcgacacgctcacctccgtgttcgcgcggcaaggactcagcctcaaagacatggtcgtcctctcaggatcgcacaccatcgggctggctcagtgcgccaccttccgggggaggatatacaacgagacgaacatcgacgcgggattcgccaggatgcggcagcgccggtgccctccgaccgccggcaacggtgacacagacctggccccgcttgacctggtcacccccggctccttcgacaacaactactacaagaacctgctgggaaagaagggcctgctgcactcggaccagctcctcttcaacggcgggtctaccgacgccacggtggtggcgtacagcaaggaccaggcggctttcttcgccgacttcgcggctgccatggtgaagatgggcgacatcagccccctcactggctccgccggggaggtcaggaaggtctgcagcgtggtgaactaa

SEQ ID NO: 314 - DNA, 20 bp, Musa acuminata
  KO gRNA
tggtgcatactggacttgca

SEQ ID NO: 315 - DNA, 17 bp, Musa acuminata
  KO gRNA after cut
tggtgcatactggactt

SEQ ID NO: 316 - DNA, 1203 bp, Musa acuminata; identical to SEQ ID NO: 71
  KO gene CDS

SEQ ID NO: 317 - DNA, 1202 bp, Artificial sequence
  KO anticipated change example
atggctagacttggaggtgaggcaacgttgacatcccgcctactcttcttcttcttgctatcgacggcggtgatgggtggcagcgcgacggtggagacaaggagaagtgtgctggggaatggcctcggcagaactcctcccatggggtggaacagctggaaccatttccactgcaacatcaacgagcggctcatcagagagactgctgatgcattggtgcatactggactgcagggctgggttatcgctacgttaacatagatgattgctggggagaagccaatagagactaccagggaaatttagttgctaagcgatcaacatttccttccggcataaagtctcttgcagattacgtgcatgcaaaagggctgaagcttggaatctatagtgatgcagggtcacagacatgcagcagaactatgcctgggtccctcggatatgaacaacatgatgcaacgacgtttgcctcctggggggttgattacttgaagtatgacaactgcaacaaccctggtaccaggccaagagaaaggtatgccaagatgagctacgctcttcggaattctggaaggaacattttcttctccctttgcgagtggggtgtagataacccagcaacctgggcgagcggtctaggcaacagttggaggacgacaggcgacatctacgatagctggggcagcatgacatcgcgcgccgatgagaacaacagatgggcatcctatgccgggcctggtggttggaatgatccagacatgctggaagtaggaaatggtggcatgtcaacggaggagtatcgatcgcattttagtatatgggcattggtcaaggctcctttgttgattggatgtgatgtgaggacgattagcggagatgcattggagatactgagcaactcagaggtcattgcggtcaatcaagactaccttggagttcaggggaagaaggtattcggaggaggcagcgaagaggtttgggcaggtcggttgagtggagggaaggtggctgtggtcctctggaacagaggaagctcgcgggcgacgatcacagcgagatggtccgacatcggcctctcgtcctccaccgtcgtcagtgttcgtgatctttgggcgcgtgcgaccatcgggtctgttcgagggcagctcgctgcgacggtggctcctcatgcgtgcaagatgtacgttctgacgccgcggtag

The invention claimed is:

1. A method for enhancing the resistance of a plant or a part thereof to at least one pathogenic fungus selected from the group consisting of *Mycosphaerella fijiensis, Mycosphaerella musicola* and *Mycosphaerella eumusae*, comprising genetically engineering at least one cell of the plant or part thereof to have enhanced expression and/or activity of at least one polypeptide having the amino acid sequence of SEQ ID NO: 176, 235, and 236, thereby enhancing the resistance of said plant or part thereof to the at least one pathogenic fungus compared to the resistance of a control plant.

2. The method of claim 1, wherein genetically engineering the at least one cell of the plant or part thereof to have enhanced expression and/or activity of the at least one polypeptide comprises introducing into the at least one cell of the plant or part thereof an exogenous polynucleotide encoding said at least one polypeptide, thereby producing a transgenic plant over-expressing said polypeptide compared to the control plant.

3. The method of claim 2, wherein the polynucleotide comprises the nucleic acid sequence set forth in any one of SEQ ID NOs: 59, 77 and 125-128.

4. A method for producing a population of plants, each having an enhanced resistance to at least one pathogenic fungus selected from the group consisting of *Mycosphaerella fijiensis, Mycosphaerella musicola* and *Mycosphaerella eumusae*, comprising the steps of:
  a. genetically engineering at least one cell of each plant of a plant population to have enhanced expression and/or activity of at least one polypeptide having the amino acid sequence selected from the group consisting of SEQ ID NOs: 176, 235, and 236 as to produce a genetically engineered plant population;
  b. inoculating each plant of the genetically engineered plant population with the at least one pathogenic fungus; and
  c. selecting plants showing an enhanced resistance to said pathogenic fungus compared to a control plant or to a pre-determined resistance score value; thereby producing a population of genetically engineered plants having enhanced resistance to said at least one pathogenic fungus.

5. A method for selecting a plant having an enhanced resistance to at least one pathogenic fungus selected from the group consisting of *Mycosphaerella fijiensis, Mycosphaerella musicola* and *Mycosphaerella eumusae*, comprising the steps of:
  a. providing a plurality of plants, each comprising at least one cell genetically engineered to have enhanced expression and/or activity of a polypeptide having the amino acid sequence selected from the group consisting of SEQ ID NOs: 176, 235, and 236;
  b. inoculating the plurality of plants with the at least one pathogenic fungus; and
  c. selecting plants showing an enhanced resistance to said at least one pathogenic fungus compared to a control plant or to a pre-determined resistance score value.

6. The method of claim 1, wherein the control plant is a plant not engineered to have modulated expression and/or activity of the at least one polypeptide.

* * * * *